US006875741B2

(12) United States Patent
Pillutla et al.

(10) Patent No.: US 6,875,741 B2
(45) Date of Patent: Apr. 5, 2005

(54) INSULIN AND IGF-1 RECEPTOR AGONISTS AND ANTAGONISTS

(76) Inventors: Renuka Pillutla, 10 Pope Rd., Bridgewater, NJ (US) 08807; Renee Brissette, 2676 Wildberry Ct., Edison, NJ (US) 08817; Arthur J. Blume, 11 Walden Dr., Annandale, NJ (US) 08801; Lauge Schäffer, Homemansgade 12, 2100-DK Copenhagen Ø (DK); Jakob Brandt, Tjoernevangen 27, 2700-DK Broenshoej (DK); Neil I. Goldstein, 26 Kendall Ave., Maplewood, NJ (US) 07040; Jane Spetzler, Øestbanegade 41,1,t.h., 2100-DK Copenhagen Ø (DK); Søren Østergaard, Borrebyvej 21, 2700-DK Broenshoej (DK); Per Hertz Hansen, Nybrovej 222, 2800-DK Lyngby (DK)

( * ) Notice: Subject to any disclaimer, the term of this patent is extended or adjusted under 35 U.S.C. 154(b) by 517 days.

(21) Appl. No.: 09/962,756

(22) Filed: Sep. 24, 2001

(65) Prior Publication Data

US 2003/0195147 A1 Oct. 16, 2003

Related U.S. Application Data

(63) Continuation-in-part of application No. 09/538,038, filed on Mar. 29, 2000, which is a continuation-in-part of application No. 09/146,127, filed on Sep. 2, 1998, now abandoned.

(51) Int. Cl.$^7$ .............................. C07K 7/06; A61K 38/17

(52) U.S. Cl. .................................. 514/12; 514/2; 514/3; 514/13; 514/17; 530/300; 530/303; 530/326; 530/330

(58) Field of Search ........................... 514/2, 3, 12, 13, 514/17

(56) References Cited

U.S. PATENT DOCUMENTS

| | | | |
|---|---|---|---|
| 5,652,214 A | 7/1997 | Lewis et al. | ................... 514/12 |
| 6,403,764 B1 | 6/2002 | Dubaquie et al. | ........... 530/300 |

FOREIGN PATENT DOCUMENTS

| | | | | |
|---|---|---|---|---|
| DE | 44 32 943 | 3/1996 | ........... | C07K/14/00 |
| EP | 0 309 050 | 3/1989 | ........... | C12N/15/00 |
| WO | WO 93/08826 | 5/1993 | ........... | A61K/37/02 |
| WO | WO 93/23067 | 11/1993 | .......... | A61K/37/02 |
| WO | WO 97/07827 | 3/1997 | .......... | A61K/48/00 |
| WO | WO 97/46683 | 12/1997 | ............ | C12N/5/12 |
| WO | WO 99/28347 | 6/1999 | ......... | C07K/14/705 |

OTHER PUBLICATIONS

Wilson, R., et al., "2.2 MB of Contiguous Nucleotide Sequence from Chromosome III of C. Elegans", Nature, GB, MacMillan Journals Ltd., London, vol. 368, No. 6466, 1994.

Database WPI, Section Ch., Week 199747, Derwent Publications Ltd., London, GB; An 1997–510880, XP002154566 & RU 2 078 769 C (A Med Biomed Chem Res Inst), 1997, Abstract.

Carroll PV, Umpleby M, Ward GS, Imuere S, Alexander E, Dunger D, Sonksen PH, and Russell–Jones DL (1997) rhIGF–I Administration Reduces Insulin Requirements, Decreases Growth Hormone Secretion, and Improves the Lipid Profile in Adults with IDDM. Diabetes 46:1453–1458.

Chen YCJ, Delbrook K, Dealwis C, Mimms L. Mushawar IK, and Mandecki W (1996) Discontinuous Epitopes of Hepatitis B Surface Antigen derived from a Filamentous Phage Peptide Library. Proc. Natl. Acad. Sci. U.S.A. 93:1997–2001.

Conover CA (1996) Regulation and Physiological Role of Insulin–Like Growth Factor Binding Proteins. Endocr. J. 43S:S43–S48.

Crowne EC, Samra JS, Cheetham T, Watts A, Holly JM, Dunger DB (1998) Recombinant Human Insulin–Like Growth Factor–I Abolishes Changes in Insulin Requirements Consequent Upon Growth Hormone Pulsatility in Young Adults with Type I Diabetes Mellitus. Metabolism 47:31–38.

De Meyts P, Wallach B, Christoffersen CT, Urdø B, Grønskov K, Latus L, Yakushiji F, Ilondo M, and Shymko RM. (1994) The Insulin–Like Growth Factor–1 Receptor Structure, Ligand–Binding Mechanism and Signal Transduction. Horm. Res. 42:152–169.*

Hoogenboom HR (1997) Designing and optimizing library selection strategies for generating high–affinity antibodies. Trends Biotechnol. 15:62–70.*

Kay BK, Adey NB, He YS, Manfredi JP, Mataragnon AH, and Fowlkes DM (1993) An M13 Phage Library Displaying Random 38–amino–acid Peptides as a Source of Novel Sequences with Affinity to Selected Targets. Gene 128:59–65.*

Mandecki W, Brissette R, Carcamo J, Cheng W, Dedova O, Hsiao KC, Moghe A, Ravera M, Shen H, Tang P, and Blume A (1997) Display Technologies—Novel Targets and Strategies, P, Guttry (Ed.). International Business Communications, Inc., Southborough, MA, pp. 231–254.*

(Continued)

*Primary Examiner*—Bennett Celsa
(74) *Attorney, Agent, or Firm*—Len Smith; Reza Green; Richard Bork

(57) ABSTRACT

Peptide sequences capable of binding to insulin and/or insulin-like growth factor receptors with either agonist or antagonist activity and identified from various peptide libraries are disclosed. This invention also identifies at least two different binding sites, which are present on insulin and insulin-like growth factor receptors, and which selectively bind the peptides of this invention. As agonists, certain of the peptides of this invention may be useful for development as therapeutics to supplement or replace endogenous peptide hormones. The antagonists may also be developed as therapeutics.

30 Claims, 118 Drawing Sheets

OTHER PUBLICATIONS

Figure 2A:

Mynarcik DC, Williams PF, Schaffer L, Yu GQ, and Whittaker J (1997) Identification of Common Ligand Binding Determinants of the Insulin and Insulin–Like Growth Factor 1 Receptors. Insights in Mechanisms of Ligand Binding. J. Biol. Chem. 272:18650–18655.*

Rader C and Barbas CF III (1997) Phage Display of Combinatorial Antibody Libraries. Curr. Opin. Biotechnol. 8:503–508.*

Rajaram S, Baylink DJ, and Mohan S (1997) Insulin–Like Growth Factor–Binding Proteins in Serum and other Biological Fluids: Regulation and Functions. Endocr.Rev. 18:801–831.*

Ravera MW, Carcamo J, Brissette R, Alam–Moghe A, Dedova O, Cheng W, Hsiao KC, Klebanov D, Shen H, Tang P, Blume A, and Mandecki W (1998) Identification of an Allosteric Binding Site on the Transcription Factor p53 Using a Phage–Displayed Peptide Library. Oncogene 16:1993–1999.*

Yanofsky SD, Balldwin DN, Butler JH, Holden FR, Jacobs JW Balsubramanian P, Cinn JP, Cwirla SE, Petter–Bhatt E, Whitehorn EA, Akeson A, Bowlin TL, Dower WJ, and Barrett RW (1996) High affinity Type I Interleukin 1 Receptor Antagonists discovered by Screening Recombinant Peptide Libraries. Proc. Natl. Acad. Sci. U.S.A.93:7381–7386.*

Pillutla, RC, et al. (2002) Peptides Identify Critical Hotspots Involved in the Biological Activation of Insulin Receptor, J. Biol.Chem. 277:22590–22594.*

U.S. Appl. No. 09/146,127, filed Sep. 2, 1998, Beasley et al.*

U.S. Appl. No. 09/538,038, filed Mar. 29, 2000, Beasley et al.*

* cited by examiner

| Clone Design | Sequence | Ratios over Background | | | Comparisons | |
|---|---|---|---|---|---|---|
| | xxxxxxxxxxxxxxxxxxxxxxxxxxxxxxx | E-Tag | IGFsR | IR | IGFR/IR | IR/IGFR |
| R40-3-40B2-IR | IRDMHYVWVQDRDRYINGVRQWYISDRYNPGSAFYRWFID | 40.3 | 9.0 | 2.0 | 4.5 | 0.2 |
| R40-4-40B12-IR | RMGLQALAHYRKSAGPIFLSSGSVIKGSEGDPFYAWFRLQ | 60.4 | 12.9 | 2.0 | 6.5 | 0.2 |
| R40-4-40G11-IR | MPVSLFRRVWDYRDGEHETLESHYVVPQAALDRLFYSWFS | 52.6 | 37.5 | 2.0 | 18.8 | 0.1 |

FIG. 1A

| Clone Design | Sequence | Ratios over Background | | | Comparisons | |
|---|---|---|---|---|---|---|
| | xxxxxxxxxxxxxxxxxxxxxxxxxxxxxxx | E-Tag | IGFsR | IR | IGFR/IR | IR/IGFR |
| R40-3-D5-IGFR | PLYGGGIHLYYPGTMGYVPGFPRQVKVLGDADKNFYDWFM | -- | -- | -- | -- | -- |
| R40-3-A6-IGFR | YRGMLVLGRISDGAGKVASEPPARIGQKVFAVNFYDWFV | -- | -- | -- | -- | -- |
| R40-X-R35-IGFR | SGCCRLLGLRWMFIVIVGWSGALVCQSAASAAGFYDWFV | -- | -- | -- | -- | -- |

FIG. 1B

| Clone Design | Sequence XXXXXXXXXXXXXXXXXXXX | Ratios over Background E-Tag | Ratios over Background IGFaR | Ratios over Background IR | Comparisons IGFR/IR | Comparisons IR/IGFR |
|---|---|---|---|---|---|---|
| R20α-3-20D3-IR | IGGQGQHQDGNFYDWFVEALA | 46.3 | 36.2 | 7.0 | 5.2 | 0.2 |
| R20α-3-20F1-IR | VEWNCRSQQLDFYEWFEQAA | 49.0 | 26.0 | 2.8 | 9.3 | 0.1 |
| R20α-3-20H1-IR | RVAGAISAPGLVSNKQDGLFYSWFRE | 45.6 | 35.3 | 3.3 | 10.7 | 0.1 |
| R20α-3-20D1-IR | VLQARHGCDSVSDCFYEWFA | 50.8 | 37.5 | 3.0 | 12.5 | 0.1 |
| R20β-4-B12-IR | GAFYRWFHEALVGSERVPDV | 41.9 | 2.9 | 5.7 | 0.5 | 2.0 |
| R20β-4-H3-IR | HEAFYDWFSALVDGGYELMG | 13.9 | 5.8 | 2.4 | 2.4 | 0.4 |
| R20β-4-D10-2-IR | RIGGWARSEGFYEWFVREL | 21.5 | 7.3 | 2.9 | 2.5 | 0.4 |
| R20β-4-C8-IR | LPAGGA?GFA?RGFYEWFES | 44.9 | 31.1 | 9.6 | 3.2 | 0.3 |
| R20β-4-E7-IR | GHSWALVRHVDRLFYEWFDL | 45.0 | 18.8 | 5.9 | 3.2 | 0.3 |
| R20β-4-E7-2-IR | LGTSAGQGVGHRAFYQWFQS | 45.0 | 18.8 | 5.9 | 3.2 | 0.3 |
| R20β-4-G3-IR | RGGGTFYEWFESALRKHGAG | 38.6 | 7.5 | 2.0 | 3.8 | 0.3 |
| R20β-4-H6-IR | NSSGQQVVGLTFYSWFASQV | 14.8 | 7.6 | 2.0 | 3.8 | 0.3 |
| R20β-4-G11-IR | FYGWFSRQLSLTPRDDWGLP | 39.4 | 7.5 | 1.9 | 3.9 | 0.3 |
| R20β-4-G8-IR | RMFYEWFWSQMGAGPTEGSA | 41.2 | 15.1 | 3.4 | 4.4 | 0.2 |
| R20β-4-H9-IR | IGGQGQHQDGNFYDWFVEALA | 43.1 | 8.8 | 2.0 | 4.4 | 0.2 |
| R20β-4-H8-IR | RDKPTDQEEQNWSFYEWFRH | 47.9 | 43.7 | 9.3 | 4.7 | 0.2 |
| R20β-4-B8-IR | WSALLSVMDTGFYAWFDDAV | 44.0 | 40.1 | 8.4 | 4.8 | 0.2 |
| R20β-4-E2-IR | SRDQTNFTFNSAGFYGWFER | 16.3 | 13.9 | 2.4 | 5.8 | 0.2 |
| R20β-4-F4-IR | GVGTLTMSSDAFYTWFV | 15.3 | 5.9 | 1.0 | 5.9 | 0.2 |
| R20β-4-A8-IR | IGGSFVEFYGWFNDQV | 43.3 | 36.0 | 6.0 | 6.0 | 0.2 |
| R20β-4-C4-IR | DIGSDGHGRRWDSFYRWFEM | 17.3 | 26.8 | 4.3 | 6.2 | 0.2 |
| R20β-4-D7-IR | VLQARHGCDSVSDCFYEWFA | 44.8 | 36.2 | 5.6 | 6.5 | 0.2 |
| R20β-4-D2-IR | DPERMQSDVGFYEWFRAAVG | 31.2 | 29.4 | 2.9 | 10.1 | 0.1 |

FIG. 1C

| Clone Design | Sequence XXXXXXXXXXXXXXXXXXXX | Ratios over Background | | | Comparisons | |
|---|---|---|---|---|---|---|
| | | E-Tag | IGFsR | IR | IGFR/IR | IR/IGFR |
| | | -- | -- | -- | -- | -- |
| R20-4-B9-IGFR | DPERMQSDVGFYEWFRAAVG | 40.1 | 16.6 | -- | -- | -- |
| R20-4-F8-IGFR | DIGSDGHGRRWDSFYRWFEM | 39.2 | 13.9 | -- | -- | -- |
| R20-4-G12-IGFR | PFYQWFLDQSVGGSRGGGLR | 36.7 | 8.0 | -- | -- | -- |
| R20-4-D10-IGFR | AVAPLSVRGRDSGFYSWFSS | 40.2 | 4.1 | -- | -- | -- |

FIG. 1D

| Clone Design | Sequence | Ratios over Background | | | Comparisons | |
|---|---|---|---|---|---|---|
| | | E-Tag | IGFsR | IR | IGFR/IR | IR/IGFR |
| | XXXXXXXXXXNFYDWFVXXX | -- | -- | -- | -- | -- |
| A6S-3-E12-IR | GRVDWLQRNANFYDWFVAELG | 26.2 | 1.3 | 8.0 | 0.2 | 6.2 |
| A6S-2-C1-IR | RMYFSTGAPQNFYDWFVQEWD | 41.2 | 1.3 | 7.0 | 0.2 | 5.4 |
| A6S-1-A7-IR | HHTQGLQVQRNFYDWFVNELR | 47.2 | 2.3 | 11.1 | 0.2 | 4.8 |
| A6S-2-C8-IR | MHRMQHDGTSNFYDWFVLQWA | 44.9 | 1.5 | 5.5 | 0.3 | 3.7 |
| A6S-3-E10-IR | AMHVVAQGGPNFYDWFVRELR | 46.9 | 1.6 | 5.0 | 0.3 | 3.1 |
| A6S-2-D5-IR | AIQMNGNLAFNFYDWFVRELI | 31.9 | 1.2 | 3.7 | 0.3 | 3.1 |
| A6S-1-B2-IR | TDRKSVQEPRNFYDWFVWAAR | 31.6 | 1.8 | 5.3 | 0.3 | 2.9 |
| A6S-1-A4-IR | PHGHRGFAQSNFYDWFVTQEE | 43.3 | 3.6 | 9.2 | 0.4 | 2.6 |
| A6S-4-G3-IR | RLASASVPGQNFYDWFVDQLL | 31.3 | 2.3 | 5.1 | 0.5 | 2.2 |
| A6S-4-H8-IR | RQSEFSTLNSNFYDWFVRELE | 11.5 | 1.7 | 3.6 | 0.5 | 2.1 |
| A6S-3-E11-IR | GQAQLSIRDVNFYDWFVQQLV | 26.3 | 2.3 | 4.4 | 0.5 | 1.9 |
| A6S-1-A1-IR | MSEPAVGVNGNFYDWFVAQLF | 36.9 | 3.7 | 6.5 | 0.6 | 1.8 |
| A6S-2-C9-IR | VGTGRARLDRNFYDWFVGQYS | 43.6 | 1.3 | 2.3 | 0.6 | 1.8 |
| A6S-2-C4-IR | SREAVQKRNANFYDWFVQQLS | 34.5 | 5.6 | 9.6 | 0.6 | 1.7 |
| A6S-4-H10-IR | LAQFAGSRNQNFYDWFVEQLG | 39.2 | 4.4 | 6.9 | 0.6 | 1.6 |
| A6S-4-G7-IR | GQEYFDQMGLNFYDWFVRELD | 19.1 | 1.4 | 2.2 | 0.6 | 1.6 |
| A6S-4-H2-IR | RQPSQPPHGSNFYDWFVEAIN | 25.5 | 2.6 | 3.9 | 0.7 | 1.5 |
| A6S-2-C3-IR | LMQSLGSGSTNFYDWFVQQMV | 31.1 | 1.6 | 2.4 | 0.7 | 1.5 |
| A6S-2-C11-IR | DQQRSACDGTNFYDWFVCQLS | 20.9 | 3.3 | 4.6 | 0.7 | 1.4 |
| A6S-3-F3-IR | LDGTKACQRVNFYDWFVCQTE | 37.1 | 3.0 | 4.2 | 0.7 | 1.4 |
| A6S-3-E5-IR | PEARRTVVHSNFYDWFVAQLS | 31.6 | 2.5 | 3.5 | 0.7 | 1.4 |
| A6S-1-B7-IR | PWMLSVGIQDNFYDWFVGLDS | 49.2 | 1.6 | 2.3 | 0.7 | 1.4 |
| A6S-3-E7-IR | ASHQRGGSSDNFYDWFVAQMR | 37.2 | 5.0 | 6.3 | 0.8 | 1.3 |
| A6S-4-G6-IR | TLEREGEFSGNFYDWFVEQLH | 16.8 | 3.1 | 4.0 | 0.8 | 1.3 |
| A6S-2-C2-IR | DRQSIGSVHGDFYDWFVSALG | 29.7 | 2.4 | 3.1 | 0.8 | 1.3 |
| A6S-3-F1-IR | DWDKLGSLSENFYDWFVDQLA | 29.7 | 2.3 | 3.0 | 0.8 | 1.3 |
| A6S-2-C5-IR | VRVVLNQSGRNFYDWFVIQLE | 42.9 | 6.1 | 7.0 | 0.9 | 1.1 |
| A6S-3-E4-IR | MASWQSRTPDNFYDWFVRELS | 20.9 | 2.1 | 2.3 | 0.9 | 1.1 |

FIG. 1E-1

| Clone Design | Sequence | Ratios over Background | | | Comparisons | |
|---|---|---|---|---|---|---|
| | | E-Tag | IGFsR | IR | IGFR/IR | IR/IGFR |
| | XXXXXXXXNFYDWFVXXX | — | — | — | — | — |
| A6S-3-E9-IR | TTCHPRGEDCNFYDWFVLQLR | 36.6 | 9.0 | 8.9 | 1.0 | 1.0 |
| A6S-3-E1-IR | VRGNDSVLRANFYDWFVDQLS | 36.7 | 6.8 | 6.9 | 1.0 | 1.0 |
| A6S-4-H12-IR | TPRSQVRSDHNFYDWFVYQLA | 46.3 | 6.1 | 5.8 | 1.1 | 1.0 |
| A6S-2-D3-IR | ESLTGSRPDRNFYDWFVQQTS | 37.0 | 5.3 | 5.1 | 1.0 | 1.0 |
| A6S-3-E8-IR | PQSLTEVRTGNFYDWFVVQLH | 42.7 | 5.2 | 5.1 | 1.0 | 1.0 |
| A6S-1-A12-IR | DVGMGRVKETNFYDWFVRQLI | 39.7 | 2.1 | 2.1 | 1.0 | 1.0 |
| A6S-4-H3-IR | GADDIRSLNTNFYDWFVNQLS | 18.6 | 3.1 | 2.9 | 1.1 | 0.9 |
| A6S-3-F7-IR | GVSIQAGYKTNFYDWFVEAVR | 46.2 | 2.3 | 2.1 | 1.1 | 0.9 |
| A6S-2-D8-IR | VGEHRQMSVGNFYDWFVMQIA | 31.2 | 2.0 | 1.7 | 1.2 | 0.9 |
| A6S-3-F10-IR | GSSLGRSGPGNFYDWFVDQLE | 39.0 | 5.9 | 4.5 | 1.3 | 0.8 |
| A6S-4-G11-IR | HRQQDVVRQGNFYDWFVQALE | 44.8 | 4.3 | 3.3 | 1.3 | 0.8 |
| A6S-2-D2-IR | QDTFLTAREGNFYDWFIRALE | 33.5 | 3.6 | 2.7 | 1.3 | 0.8 |
| A6S-4-G8-IR | EAIMREEGQANFYDWFVRQLE | 11.1 | 2.5 | 1.9 | 1.3 | 0.8 |
| A6S-4-H6-IR | VCDVSTGGGTNFYDWFVCQVG | 22.4 | 2.4 | 1.9 | 1.2 | 0.8 |
| A6S-2-D10-IR | PQPRSASTPLNFYDWFVQATG | 41.3 | 2.1 | 1.7 | 1.4 | 0.7 |
| A6S-3-F4-IR | GVSRGSGGDPNFYDWFVMQLR | 37.0 | 13.5 | 9.9 | 1.4 | 0.7 |
| A6S-3-F5-IR | GPGRHDSSRGNFYDWFVEQLA | 36.2 | 11.8 | 7.8 | 1.5 | 0.7 |
| A6S-4-H1-IR | ERFALEVQGSNFYDWFVRQVI | 48.1 | 7.2 | 4.8 | 1.5 | 0.7 |
| A6S-3-F6-IR | NLKSSATVGGNFYDWFVEQL | 18.3 | 3.6 | 2.6 | 1.4 | 0.7 |
| A6S-3-F11-IR | MEGPPAGGPLNFYDWFVAQVD | 18.7 | 2.9 | 1.9 | 1.5 | 0.7 |
| A6S-2-C6-IR | RLDVAGHRGGNFYDWFVKQLH | 33.8 | 2.0 | 1.4 | 1.4 | 0.6 |
| A6S-4-G4-IR | PWSDHEALNQNFYDWFVSQVL | 46.7 | 19.2 | 12.1 | 1.6 | 0.6 |
| A6S-4-G12-IR | EDRLGNGESTNFYDWFVRQLA | 36.9 | 18.2 | 10.7 | 1.7 | 0.6 |
| A6S-2-D7-IR | GKLVASTLDDNFYDWFVRQLS | 32.8 | 12.8 | 7.9 | 1.6 | 0.6 |
| A6S-4-G10-IR | SGPVVQTQNGNFYDWFVHQLR | 33.2 | 12.0 | 7.1 | 1.7 | 0.6 |
| A6S-3-F9-IR | VDRAGPAGSDNFYDWFVAQLD | 33.9 | 10.8 | 6.8 | 1.6 | 0.6 |
| A6S-3-F2-IR | SLGRNDRPDENFYDWFVSQVQ | 44.3 | 9.6 | 5.7 | 1.7 | 0.6 |
| | RVMATANAPMNFYDWFVQLQ | 23.2 | 4.3 | 2.5 | 1.7 | 0.6 |

FIG. 1E-2

| Clone Design | Sequence | Ratios over Background | | | Comparisons | |
|---|---|---|---|---|---|---|
| | | E-Tag | IGFsR | IR | IGFR/IR | IR/IGFR |
| | XXXXXXXXXXNFYDWFVXXXX | -- | -- | -- | -- | -- |
| A6S-4-G1-IR | NGVERAGTGDNFYDWFVAQLH | 36.2 | 31.8 | 15.7 | 2.0 | 0.5 |
| A6S-1-A3-IR | PFAGKGDKTGNFYDWFVSLTG | 39.9 | 12.6 | 6.0 | 2.1 | 0.5 |
| A6S-3-F12-IR | GMPQEYMDQVNFYDWFVAQVD | 41.4 | 7.4 | 4.0 | 1.9 | 0.5 |
| A6S-4-G2-IR | MGTPAVGDGANFYDWFVRQLG | 26.7 | 7.0 | 3.5 | 2.0 | 0.5 |
| A6S-1-B1-IR | SKCKAWYGANNFYDWFVWQVD | 30.6 | 3.7 | 1.9 | 1.9 | 0.5 |
| A6S-2-D11-IR | EAASLGSQDRNFYDWFVRQVV | 48.4 | 37.4 | 13.5 | 2.8 | 0.4 |
| A6S-2-D1-IR | VERSASSQDGNFYDWFVVQIR | 37.8 | 30.6 | 12.0 | 2.6 | 0.4 |
| A6S-3-E2-IR | TSEVQRRSQDNFYDWFVAQVA | 33.1 | 24.7 | 9.8 | 2.5 | 0.4 |

FIG. 1E-3

FIG. 1F-1

| Clone Design | Sequence | Ratios over Background E-Tag | IGF9R | IR | Comparisons IGFR/IR | IR/IGFR |
|---|---|---|---|---|---|---|
| | XXXXXXXXXNFYDWFVXXX | -- | -- | -- | -- | -- |
| A6S-4-E4-IGFR | ERSAAGFREGNFYDWFVAQVN | 27 | 32 | -- | -- | -- |
| A6S-2-D2-IGFR | RAERGSMRDSNFYDWFVQQLP | 36 | 30 | -- | -- | -- |
| A6S-2-F2-IGFR | LAMSVASRPANFYDWFVAQIV | 35 | 30 | -- | -- | -- |
| A6S-4-F3-IGFR | HNSSSPMRTGNFYDWFVQELR | 26 | 30 | -- | -- | -- |
| A6S-4-G4-IGFR | SALSGPVQPINFYDWFVTGM | 26 | 29 | -- | -- | -- |
| A6S-4-G3-IGFR | GAQAIREIHHNFYDWFVAQVT | 21 | 28 | -- | -- | -- |
| A6S-2-H2-IGFR | RGQRESDSGTNFYDWFVGAIR | 40 | 28 | -- | -- | -- |
| A6S-2-E3-IGFR | VQEGLSGMEGNFYDWFVDQLF | 36 | 28 | -- | -- | -- |
| A6S-4-C6-IGFR | RLDRSSTSGVNFYDWFVAQVG | 25 | 28 | -- | -- | -- |
| A6S-4-F5-IGFR | GSQHSGREPHNFYDWFVAQVG | 24 | 28 | -- | -- | -- |
| A6S-4-H3-IGFR | GRGDQRHETTNFYDWFVRELQ | 20 | 28 | -- | -- | -- |
| A6S-4-H4-IGFR | PRMVEKPSEDNFYDWFVTQLS | 20 | 28 | -- | -- | -- |
| A6S-2-H1-IGFR | RVGIQVDEHTNFYDWFVIQLI | 42 | 27 | -- | -- | -- |
| A6S-4-E6-IGFR | RSSGGLLSQGNFYDWFVSQLE | 24 | 26 | -- | -- | -- |
| A6S-4-B6-IGFR | SDARQAGLQENFYDWFVSQVR | 23 | 26 | -- | -- | -- |
| A6S-4-D2-IGFR | PPYRSSRLGENFYDWFVMQVR | 19 | 26 | -- | -- | -- |
| A6S-4-G5-IGFR | QEVTRTRDDKNFYDWFVSQIF | 18 | 26 | -- | -- | -- |
| A6S-2-A3-IGFR | SRAPYGSTAGNFYDWFVQAVS | 37 | 25 | -- | -- | -- |
| A6S-4-E2-IGFR | 7DGQSVSSKGNFYDWFVQQMT | 25 | 25 | -- | -- | -- |
| A6S-4-G6-IGFR | RLMGGIAEPQNFYDWFVREVA | 20 | 25 | -- | -- | -- |
| A6S-4-G2-IGFR | SAGHHMPRESNFYDWFVDQVV | 25 | 24 | -- | -- | -- |
| A6S-4-D6-IGFR | LGAAETWDGINFYDWFVKQVS | 22 | 24 | -- | -- | -- |
| A6S-4-F4-IGFR | VGHSGVPPYPNFYDWFVMQVS | 22 | 24 | -- | -- | -- |
| A6S-4-C3-IGFR | VTMLDKGAQDNFYDWFVREVA | 21 | 24 | -- | -- | -- |
| A6S-4-H5-IGFR | HHSPGNEHGYNFYDWFVLQVA | 19 | 24 | -- | -- | -- |
| A6S-4-H6-IGFR | GSIAQLIMRANFYDWFVEQTN | 18 | 24 | -- | -- | -- |
| A6S-4-F6-IGFR | LKGSSQPLSVNFYDWFVQQIK | 17 | 24 | -- | -- | -- |
| A6S-3-H1-IGFR | PASNKNSLAENFYDWFVQQTR | 30 | 23 | -- | -- | -- |

| Ratios over Background Clone Design | Sequence | Comparisons E-Tag | IGFaR | IR | IGFR/IR | IR/IGFR |
|---|---|---|---|---|---|---|
| | XXXXXXXXXNFYDWFVXXX | -- | -- | -- | -- | -- |
| A6S-4-A6-IGFR | HVEHMAVGDGNFYDWFVVQLR | 21 | 23 | -- | -- | -- |
| A6S-4-E3-IGFR | RGMTGMVGRGNFYDWFVGQLR | 21 | 23 | -- | -- | -- |
| A6S-4-D3-IGFR | GLRSEQGNRLNFYDWFVAQIA | 20 | 23 | -- | -- | -- |
| A6S-3-E10-IGFR | RVREKLPRPENFYDWFVNQIH | 23 | 22 | -- | -- | -- |
| A6S-4-D1-IGFR | SNPSRQDASVNFYDWFVREVA | 22 | 22 | -- | -- | -- |
| A6S-4-B2-IGFR | QSVDLSRPDSNFYDWFVEVLS | 21 | 22 | -- | -- | -- |
| A6S-4-A2-IGFR | IGGQGQHQDGNFYDWFVEALA | 20 | 22 | -- | -- | -- |
| A6S-4-A5-IGFR | VEVQRHIRKDNFYDWFVKQID | 19 | 22 | -- | -- | -- |
| A6S-4-C1-IGFR | CWARPCGDAANFYDWFVQQAS | 16 | 22 | -- | -- | -- |
| A6S-4-B1-IGFR | RHERGKEGPGNFYDWFVSQVV | 19 | 21 | -- | -- | -- |
| A6S-4-B4-IGFR | ERSPRPALASNFYDWFVQQVV | 19 | 21 | -- | -- | -- |
| A6S-4-D4-IGFR | IARMRETFQPNFYDWFVDQLA | 18 | 21 | -- | -- | -- |
| A6S-3-F8-IGFR | GRGQGLKRPDNFYDWFVAAAK | 25 | 20 | -- | -- | -- |
| A6S-3-H9-IGFR | YSIEVQDWNENFYDWFVSQLG | 23 | 20 | -- | -- | -- |
| A6S-3-G2-IGFR | TWMEERKQDNFYDWFVGQLK | 21 | 20 | -- | -- | -- |
| A6S-4-H2-IGFR | VTFTSAVFHENFYDWFVRQVS | 19 | 20 | -- | -- | -- |
| A6S-4-A3-IGFR | LAINDLVTHKNFYDWFVDQLR | 18 | 19 | -- | -- | -- |
| A6S-3-G10-IGFR | GAVGLAEAGPNFYDWFVSQVQ | 24 | 19 | -- | -- | -- |
| A6S-3-E5-IGFR | RYRGERHDGRNFYDWFVEQVN | 21 | 19 | -- | -- | -- |
| A6S-3-H2-IGFR | QGAEGRLSEGNFYDWFVQAVS | 21 | 18 | -- | -- | -- |
| A6S-3-G3-IGFR | PRLHMGSDMGDFYDWFVVQIA | 21 | 18 | -- | -- | -- |
| A6S-4-H1-IGFR | IVAGARHSEVNFYDWFVIQVR | 18 | 16 | -- | -- | -- |
| A6S-4-G1-IGFR | AELVGAGVRGNFYDWFVDQLV | 16 | 16 | -- | -- | -- |
| A6S-4-A1-IGFR | DSSRLWLGERNFYDWFVAQI3 | 17 | 12 | -- | -- | -- |
| A6S-2-F1-IGFR | VGQVGRYVRSNFYDWFVQQAM | 30 | 8 | -- | -- | -- |
| A6S-2-G1-IGFR | RPQLVESGSKNFYDWFVQVVR | 30 | 8 | -- | -- | -- |
| A6S-1-C5-IGFR | RIHNQTERGGNFYDWFVHQLV | 27 | 7 | -- | -- | -- |
| A6S-2-B2-IGFR | EMYGDTSERVNFYDWFVSALQ | 30 | 5 | -- | -- | -- |

FIG. 1F-2

| Ratios over Background Clone | | Comparisons | | | | | |
|---|---|---|---|---|---|---|---|
| Design | Sequence | E-Tag | IGFaR | IR | IGFR/IR | IR/IGFR |
| | XXXXXXXXXNFYDWFVXXXX | -- | -- | -- | -- | -- |
| A6S-1-D5-IGFR | RVGSGMEDLGNFYDWFVRQAQ | 25 | 5 | -- | -- | -- |
| A6S-1-A2-IGFR | KDPVTVSQGRNFYDWFVVQIQ | 20 | 5 | -- | -- | -- |
| A6S-3-E6-IGFR | DARDHGVWVMSNFYDWFVAQVS | 20 | 5 | -- | -- | -- |
| A6S-1-G3-IGFR | VATVHVGGGMNFYDWFVAQVG | 19 | 5 | -- | -- | -- |
| A6S-3-G4-IGFR | CADPGACSSLNFYDWFVQMRG | 21 | 4 | -- | -- | -- |
| A6S-3-H8-IGFR | NPTSVQQYGVNFYDWFVNVLS | 20 | 4 | -- | -- | -- |
| A6S-3-E3-IGFR | RPSLPEVRPGNFYDWFVQSVR | 19 | 4 | -- | -- | -- |
| A6S-3-D9-IGFR | SLQGADFQQGNFYDWFVSELA | 17 | 3 | -- | -- | -- |
| A6S-2-A1-IGFR | LSSRGRVTMRNFYDWFVAQVV | 31 | 3 | -- | -- | -- |
| A6S-1-H4-IGFR | HKSWTTMSPLNFYDWFVAQVE | 18 | 3 | -- | -- | -- |
| A6S-3-C1-IGFR | RPVIGGGTRNFYDWFVAQMI | 17 | 3 | -- | -- | -- |
| A6S-3-B10-IGFR | YDQDPPXWGLNFYDWFVREVA | 16 | 3 | -- | -- | -- |

FIG. 1F-3

| Clone | Sequence | Ratios over Background | | | Comparisons | |
|---|---|---|---|---|---|---|
| | | E-Tag | IGFsR | IR | IGFR/IR | IR/IGFR |
| Parental/D sign | YRGMLVLGRISDGAGKVASEPPARIGQKVFAVNFYDWFV | 19.0 | .4.0 | -- | -- | -- |
| A6L-3-D1-IR | QRGMLVRGRISHGAGKIAYEPPDCLGQKACAVNFYDWFV | 22.6 | 19.8 | 26.5 | 0.7 | 1.3 |
| A6L-4-H7-IR | QRGMLLLGRISDDAGKVASEPSARRGQKVFAFNFYDWFV | 37.5 | 3.5 | 4.2 | 0.8 | 1.2 |
| A6L-4-H4-IR | YRGILVLGRISEGAGKVASEPAARIGQKVFADFYDWFV | 38.5 | 21.1 | 25.8 | 0.8 | 1.2 |
| A6L-4-E4-IR | QRGMLALGRISDGAGKVASEPPAGIGQKVFAFNFYDWFV | 38.1 | 5.4 | 6.0 | 0.9 | 1.1 |
| 6L-4-G7-IR | FRGRLVLGHFSDGAGKVGSEPAARIGQKVFDVNFYDWFV | 38.6 | 16.2 | 18.5 | 0.9 | 1.1 |
| 6L-3-C3-IR | YRGMLVLGRISDGAGKVASEPPARIGQEVFADNFYDWFV | 34.7 | 21.8 | 23.1 | 0.9 | 1.1 |
| A6L-3-B6-IR | YRGMLVLGRISDGAGEVASEPPARIGQEVFALNFYDWFV | 33.1 | 27.8 | 30.3 | 0.9 | 1.1 |
| A6L-4-G11-IR | VPWYAGSGSSSDGAGKVASEPPARIDQKVFAVNFYDWFV | 27.6 | 2.0 | 2.0 | 1.0 | 1.0 |
| A6L-4-G12-IR | YRGQLVLGRISYGAGKVGCDPPARIGQKDWAVNFYDWFV | 32.0 | 2.3 | 2.3 | 1.0 | 1.0 |
| A6L-3-A10-IR | QRGLLVLGRFSDGAGNVASEPPAGIGQEVFPVNFYDWFV | 21.1 | 2.4 | 2.4 | 1.0 | 1.0 |
| A6L-4-E12-IR | QRGMLVLGRISDGAGKVAAEPPDCLGQKVCAVNFYDWFV | 3.1 | 2.4 | 2.4 | 1.0 | 1.0 |
| A6L-4-E10-IR | QRGMRVLGRISDGAGKVASELPRIGQKDFAVNFYDWFV | 30.1 | 3.8 | 3.8 | 1.0 | 1.0 |
| A6L-4-G8-IR | QRGMLVLGSISDGAGKVAYEAPARIGQTVFAVNFYDWFV | 37.9 | 4.7 | 4.7 | 1.0 | 1.0 |
| A6L-3-C12-IR | QPWCAGSGRIYDGACKVASEPPAHIGQEVFAVNFYDWFV | 29.5 | 5.7 | 5.7 | 1.0 | 1.0 |
| A6L-4-H11-IR | QRGMLVLDRISDGAGKVASGPPARIGQNVLAVNFYDWFV | 35.4 | 9.6 | 9.6 | 1.0 | 1.0 |
| A6L-4-F10-IR | YRGMLVVGRISDGTGKVASQPPARIGQKVFAVNFYDWFV | 31.6 | 10.5 | 10.5 | 1.0 | 1.0 |
| A6L-4-E9-IR | YRGMLVLGRISDGAGKVASVPPAHIGQKVEAFNFYDWFV | 39.8 | 12.9 | 12.9 | 1.0 | 1.0 |
| A6L-4-H8-IR | QHGMLVLGRVSVGAGKVPSEPQARIGHKVFDVNFYDWFV | 38.2 | 14.6 | 14.6 | 1.0 | 1.0 |
| A6L-3-A11-IR | YSGYAGSGSFSDGAGKVASEPPARISQEVLADNFYDWFV | 29.0 | 17.5 | 17.5 | 1.0 | 1.0 |
| A6L-4-F9-IR | YRGMLVLGRISDGAGKVASEPPARIGQKVSAVNFYDWFV | 35.7 | 18.4 | 18.4 | 1.0 | 1.0 |
| A6L-4-G2-IR | YHGKLDLGRISVGVGKVASEPPARIGQKVFADNFYDWFV | 29.5 | 21.4 | 20.7 | 1.0 | 1.0 |
| A6L-4-E8-IR | YRGQAGSGVGSLTVAGKVASDPPARIGQKVEADNFYDWFV | 28.7 | 21.6 | 21.6 | 1.0 | 1.0 |
| A6L-4-H10-IR | HRGMLVLGRISEGAGNVDPEPPARIGQNVFAGNFYDWFV | 30.0 | 22.1 | 22.1 | 1.0 | 1.0 |
| A6L-4-G9-IR | QRGMPVLGRISDGAGKVGSEPPARIARKVFPVNFYDWFI | 37.1 | 22.6 | 22.6 | 1.0 | 1.0 |
| A6L-4-F7-IR | QGGLLVTGRISDGAGKVASEPPGGIGQKVFAGNFYDWFV | 28.6 | 23.6 | 24.4 | 1.0 | 1.0 |
| A6L-4-E11-IR | YPWYGGSGTYLDGAGKVASEPPARIDQQVFAGNFYDWFV | 38.4 | 26.5 | 26.5 | 1.0 | 1.0 |

FIG. 1G-1

| Clone | Sequence | Ratios over Background | | | Comparisons | |
|---|---|---|---|---|---|---|
| Parental/Design | | E-Tag | IGFaR | IR | IGFR/IR | IR/IGFR |
| A6L-4-H9-IR | YRGMLVLGRISDGAGKVASEPPARIGQKVFAVNFYDWFV | 19.0 | 4.0 | -- | -- | -- |
| A6L-4-E1-IR | YRAMLVLRRIISDVAGIVDSEPPTRIGQKVFEAGNFYDWFV | 37.5 | 27.3 | 27.3 | 1.0 | 1.0 |
| A6L-3-A5-IR | YRGMLVLGRISQGAGNVASEPSSRIGQKVFEAGNFYDWFI | 35.4 | 32.6 | 31.4 | 1.0 | 1.0 |
| A6L-4-G4-IR | YRGMLVLGRISDGAGKVDYEPPARIGQKVFEAGNFYDWFV | 38.3 | 34.6 | 35.5 | 1.0 | 1.0 |
| 6L-4-G4-IR | YRGMLGLGGISAGAGIVASEPPARVGQKVFEAGNFYDWFV | 30.4 | 17.7 | 15.2 | 1.2 | 0.9 |
| .6L-4-H2-IR | YRGILFQGRIPDGAGKVASEPPTRIGERVFAVNFYDWFV | 36.1 | 4.2 | 3.6 | 1.1 | 0.9 |
| A6L-4-E6-IR | QGGMPVLGRISDGAGKVAFEPPARIGQKVFAGNFYDWFV | 28.6 | 24.1 | 22.7 | 1.1 | 0.9 |
| A6L-4-H5-IR | YRGMLVLGRIQDGAGKVASEPPARIGQKVFTGNFYDWFV | 37.2 | 24.6 | 23.1 | 1.1 | 0.9 |
| A6L-4-H3-IR | QRGMLVLGGVSDGAGKVASDPPASIGQNVFAVNFYDWFV | 37.1 | 9.1 | 7.2 | 1.3 | 0.8 |
| A6L-4-E5-IR | YPGMLILDRISDGASKVVSEPPASIGQKVFAVNFYDWFV | 42.1 | 30.6 | 24.4 | 1.3 | 0.8 |
| A6L-3-C5-IR | YRGMLVLDRISDGAGKVASEQPARIGQEVYAVNFYDWFV | 42.2 | 21.9 | 17.5 | 1.2 | 0.8 |
| A6L-4-G6-IR | YRGMLVLGRISGGVGKVASESPARIGQKVYAVNFYDWFV | 29.8 | 4.3 | 2.8 | 1.5 | 0.7 |
| A6L-3-D4-IR | QRGMVLVLGRISDGAGEVASEKVFAVNFYDWFV | 39.9 | 12.4 | 8.4 | 1.5 | 0.7 |
| A6L-3-A7-IR | QRGMLVLGRVSDGAGKVDSAPPARIGQKVFEAGNFYDWFV | 31.0 | 21.2 | 14.0 | 1.5 | 0.7 |
| A6L-3-A6-IR | QRGMLVLGRMSDGAGKVAFEPPARIGQRGFAGNFYDWFV | 25.5 | 12.3 | 8.8 | 1.4 | 0.7 |
| A6L-4-E7-IR | QRGTLVLGRISDGAGKAASEPPARIGQNVFAVNFYDWFV | 38.4 | 12.5 | 7.1 | 1.7 | 0.6 |
| A6L-3-C6-IR | QRGMLVLDRISDGAGKVAAEPPARIGQKVFALNFYDWFI | 28.8 | 10.9 | 6.7 | 1.6 | 0.6 |
| A6L-4-F5-IR | QRGMLVLGRISDGAGEVASEPPARIGEKVYAVNFYDWFV | 33.8 | 6.3 | 4.1 | 1.5 | 0.6 |
| A6L-3-B7-IR | QRGILVRGRISDGAGKVGSEPPARSGEKVFAVNFYDWFV | 27.6 | 9.4 | 5.0 | 1.9 | 0.5 |
| A6L-4-F4-IR | QLGMVVLGRISDGSGKAASEPAARISQKVFAVNFYDWFV | 38.9 | 17.6 | 9.4 | 1.9 | 0.5 |
| .6L-4-E3-IR | QRGMLVLGRISDGDGKVASEPPARIGQRVFAVNFYDWFV | 38.0 | 6.9 | 3.8 | 1.8 | 0.5 |
| A6L-0-E6-IR | YRGMLVLGRSSDGAGKVAFERPARIGQTVFAVNFYDWFV | 31.0 | 31.0 | 1.8 | 17.0 | 0.1 |
| A6L-0-E4-IR | YRGMLVLGRISDGAG#VASEPPARIGRKVFAVNFYDWFV | 26.0 | 16.0 | 1.3 | 13.0 | 0.1 |
| A6L-0-H3-IR | YRGMLVLGRISGGAGKAASERPARIGQKVSAVNFYDWFV | 27.0 | 26.0 | 2.0 | 13.0 | 0.1 |

FIG. 1G-2

| Clone | Sequence | Ratios over Background E-Tag | IGF₅R | IR | Comparisons IGFR/IR | IR/IGFR |
|---|---|---|---|---|---|---|
| Parental/Design | YRGMLVLGRISDGAGKVASEPPARIGQKVFAVNFYDWFV | 19 | 4 | — | — | — |
| A6L-4-F8-IGFR | YRGMMVQGRISDGAGKVASVSPVRIGQKVIAVNFYDWFV | 26 | 28 | — | — | — |
| A6L-2-G9-IGFR | YRGRLGLGRISDVAGKVACDPSARIGQKVLPVNFYDWFV | 39 | 22 | — | — | — |
| A6L-4-E7-IGFR | YRGMLVLGRISDGAGRVASEPQARIGQKVFAVNFYDWFV | 23 | 22 | — | — | — |
| A6L-4-G10-IGFR | QGGMLVPGRISDGAGKVASQPPARIGPKGFAGNFYDWFV | 19 | 22 | — | — | — |
| A6L-2-E9-IGFR | YRGMRVLGRISDGAGKVASEPPTHIGQKVFPVNFYDWFV | 38 | 21 | — | — | — |
| A6L-2-D6-IGFR | YRGMLVLGRISDGAGKVGSEPAARIGQKVFALNFYDWFV | 34 | 21 | — | — | — |
| A6L-3-H12-IGFR | YRGQGMVLGRISDGAGKVASEPPGRIGQKVFPVNFYDWFV | 24 | 21 | — | — | — |
| A6L-4-A7-IGFR | YRGMLGLGRITGGAGKVASEPPDRIGQHVFVDNFYDWFV | 20 | 20 | — | — | — |
| A6L-4-B8-IGFR | YRGMLGLGRISDGAGNVASEAPARIGQKVFAVNFYDWFV | 20 | 19 | — | — | — |
| A6L-4-G7-IGFR | DGMLVLGRISDGAGKAASDPRARIGQTVLDVNFYDWFV | 19 | 19 | — | — | — |
| A6L-2-D9-IGFR | YRGMRVRGRISDGAGKVAYEPPARMGQKGEAVNFYDWFV | 38 | 18 | — | — | — |
| A6L-4-F7-IGFR | YRGMWVLGRISYGAGKVAGIVASEPPARIGQKVFAVNFYDWFV | 18 | 18 | — | — | — |
| A6L-4-E12-IGFR | YRGLLGLGGISDGAGKVASEPPARNGQKVFAVNFYDWFV | 15 | 13 | — | — | — |
| A6L-4-H7-IGFR | YRGMLGLGRISAGAGKVASGAPARIGQEDFAVNFYDWFV | 14 | 13 | — | — | — |
| A6L-4-H12-IGFR | YRGMLALGRISEGAGKVASEPPARIGQNVFAVNFYDWFV | 13 | 12 | — | — | — |
| A6L-2-A4-IGFR | YRGMLVLGRISDGAGKVASEPPARIGQKVLAVNFYDWFV | 17 | 4 | — | — | — |
| A6L-3-D10-IGFR | YPGMLVPGRISDGAGEGATDPPPRIGQKVFAFNFYDWFV | 16 | 4 | — | — | — |
| A6L-2-F6-IGFR | YRGMLVPGRISDGAGKVAYEPPARIGQKIFAVNFYDWFV | 15 | 4 | — | — | — |
| A6L-2-B11-IGFR | YRGVLVLGRVSDGVGKVASEPPAHRGQRVFGVNFYDWFV | 26 | 3 | — | — | — |
| A6L-1-B7-IGFR | YRRMLVLGRISDGAANVASGPPDRIGQKVFAGNFYDWFV | 23 | 3 | — | — | — |
| A6L-1-D8-IGFR | YRRMLALGRFSDVTGDVASEPPAHIGQKVVAVNFYDWFV | 23 | 3 | — | — | — |
| 16L-0-A11-IGFR | YRGMVVRGRIFDGPGKVASEPRARIGQKVFAVNFYDWFV | 19 | 3 | — | — | — |
| A6L-3-B7-IGFR | YRGMLILGRISDGAGKVASEPPARVGQDVVAVNFYDWFV | 9 | 2 | — | — | — |
| A6L-1-G7-IGFR | YPGRLVGGRISDGVGKVASEPPGRIGQKVFAVNFYDWFV | 20 | 2 | — | — | — |
| A6L-1-B9-IGFR | QRGLLVLGRIFDGAGKVASDPPARIGQKDFADNFYDWFV | 18 | 2 | — | — | — |
| A6L-1-C9-IGFR | YRGMLVLGRISDGAGKVAFEPPARIGQNVFAVNFYDWFV | 18 | 2 | — | — | — |
| A6L-0-G10-IGFR | YRCMPVLGRISDGAG#VASDRPARIGQKVFAVNFYDWFV | 18 | 2 | — | — | — |
| A6L-1-G8-IGFR | YRGRLVLGRISDGAGKVAAEPPASMDSKVFAGNFYDWFV | 15 | 2 | — | — | — |

FIG. 1H

| Clone Design | Sequence | Ratios over Background | | | Comparisons | |
|---|---|---|---|---|---|---|
| | | E-Tag | IGFsR | IR | IGFR/IR | IR/IGFR |
| | GFREGNFYDWFVAQVT | -- | -- | -- | -- | -- |
| E4Dα-1-B8-IR | GFREGQRWYWFVAQVT | 40.7 | 1.0 | 12.3 | 0.1 | 12.3 |
| E4Dα-3-E5-IR | GFREGYFYDWFLAQVT | 39.6 | 2.0 | 1.5 | 1.3 | 0.8 |
| E4Dα-1-A1-IR | GFREGDFYEWFVAQVT | 48.7 | 44.9 | 31.4 | 1.4 | 0.7 |
| E4Dα-2-D9-IR | GFREGQFYEWFAAQVT | 22.9 | 3.3 | 2.4 | 1.4 | 0.7 |
| E4Dα-1-B3-IR | GFREGTFYDWFVAQVT | 41.8 | 38.6 | 26.5 | 1.5 | 0.7 |
| E4Dα-1-A6-IR | GFREGNFYDWFEAQVT | 56.3 | 51.2 | 32.6 | 1.6 | 0.6 |
| E4Dα-1-A10-IR | GFREGAFYDWFEAQVT | 48.9 | 42.2 | 26.5 | 1.6 | 0.6 |
| E4Dα-1-A8-IR | GFREGAFYDWFVAQVT | 46.9 | 41.5 | 26.2 | 1.6 | 0.6 |
| E4Dα-1-B1-IR | GFREGKFYQWFEAQVT | 44.1 | 31.1 | 19.7 | 1.6 | 0.6 |
| E4Dα-2-C9-IR | GFREGDFYDWFQAQVT | 34.0 | 8.1 | 4.8 | 1.7 | 0.6 |
| E4Dα-1-A3-IR | GFREGTFYEWFVAQVT | 45.3 | 40.3 | 22.5 | 1.8 | 0.6 |
| E4Dα-1-A9-IR | GFREGNFYDWFVAQVT | 46.9 | 41.0 | 22.5 | 1.8 | 0.5 |
| E4Dα-3-F3-IR | GFREGYFYEWFLAQVT | 37.2 | 14.1 | 8.0 | 1.8 | 0.6 |
| E4Dα-2-D3-IR | GFREGQFYDWFLAQVT | 35.1 | 16.3 | 8.7 | 1.9 | 0.5 |
| E4Dα-2-D6-IR | GFREGEFYDWFQAQVT | 33.2 | 5.6 | 2.8 | 2.0 | 0.5 |
| E4Dα-3-F10-IR | GFREGQFYDWFRAQVT | 27.8 | 4.5 | 2.3 | 2.0 | 0.5 |
| E4Dα-2-D5-IR | GFREGYFYEWFQAQVT | 43.8 | 23.8 | 11.4 | 2.1 | 0.5 |
| E4Dα-3-F4-IR | GFREGDFYQWFEAQVT | 25.9 | 7.6 | 3.7 | 2.1 | 0.5 |
| '4Dα-3-E3-IR | GFREGSFYGWFQAQVT | 34.6 | 4.0 | 1.9 | 2.1 | 0.5 |
| E4Dα-3-F8-IR | GFREGSFYAWFQAQVT | 20.9 | 16.0 | 7.4 | 2.2 | 0.5 |
| E4Dα-2-C1-IR | GFREGQFYDWFVAQVT | 43.1 | 11.6 | 5.0 | 2.3 | 0.4 |
| E4Dα-1-B4-IR | GFREGIFYEWFVAQVT | 45.3 | 6.6 | 2.9 | 2.3 | 0.4 |

FIG. 1I-1

| Clone Design | Sequence | Ratios over Background | | | Comparisons | |
|---|---|---|---|---|---|---|
| | | E-Tag | IGFsR | IR | IGFR/IR | IR/IGFR |
| | GFREGNFIDWFVAQVT | -- | -- | -- | -- | -- |
| E4Dα-4-H5-IR | GFREGSFYEWFQAQVT | 47.2 | 36.0 | 14.7 | 2.4 | 0.4 |
| E4Dα-1-B12-IR | GFREGNFYDWFAAQVT | 47.6 | 33.4 | 13.8 | 2.4 | 0.4 |
| E4Dα-4-G2-IR | GFREGSFYDWFVAQVT | 23.4 | 20.4 | 8.6 | 2.4 | 0.4 |
| E4Dα-3-F9-IR | GFREGDFYDWFVAQVT | 36.2 | 15.6 | 6.3 | 2.5 | 0.4 |
| E4Dα-4-G6-IR | GFREGDFYQWFVAQVT | 26.0 | 4.9 | 2.0 | 2.5 | 0.4 |
| E4Dα-4-H9-IR | GFREGGFYDWFVAQVT | 47.8 | 24.8 | 9.5 | 2.6 | 0.4 |
| E4Dα-2-C10-IR | GFREGDFYGWFQAQVT | 42.4 | 23.2 | 9.0 | 2.6 | 0.4 |
| E4Dα-1-B2-IR | GFREGVFYDWFVAQVT | 39.4 | 18.7 | 7.2 | 2.6 | 0.4 |
| E4Dα-3-F12-IR | GFREGGFYEWFQAQVT | 38.9 | 16.6 | 5.6 | 3.0 | 0.3 |
| E4Dα-2-D11-IR | GFREGSFYDWFQAQVT | 40.2 | 11.1 | 3.3 | 3.4 | 0.3 |
| E4Dα-4-H2-IR | GFREGNFYEWFQAQVT | 37.8 | 33.9 | 8.2 | 4.1 | 0.2 |
| E4Dβ-4-A12-IR | GFREGKFYDWFLAQVT | 41.1 | 8.3 | 28.7 | 0.3 | 3.5 |
| E4Dβ-4-A10-IR | GFREGEFYEWFVAQVT | 5.8 | 1.2 | 2.4 | 0.5 | 2.0 |
| E4Dβ-4-E10-IR | GFREGRFYDWFVAQVT | 9.6 | 1.2 | 2.2 | 0.5 | 1.8 |
| E4Dβ-4-B11-IR | GFREGTFYDWFQAQVT | 36.1 | 15.2 | 26.9 | 0.6 | 1.8 |
| E4Dβ-4-C10-IR | GFREGEFYEWFAAQVT | 27.8 | 13.3 | 23.7 | 0.6 | 1.8 |
| E4Dβ-4-E8-IR | GFREGDFYEWFEAQVT | 28.7 | 16.7 | 28.2 | 0.6 | 1.7 |
| E4Dβ-4-G7-IR | GFREGHFYDWF?AQVT | 30.9 | 14.7 | 24.7 | 0.6 | 1.7 |
| E4Dβ-4-C8-IR | GFREGEFYDWFVAQVT | 35.5 | 22.5 | 32.9 | 0.7 | 1.5 |
| E4Dβ-4-A8-IR | GFREGSFYDWFVAQVT | 31.2 | 14.5 | 22.2 | 0.7 | 1.5 |
| E4Dβ-4-A9-IR | GFREGSFYDWFQAQVT | 35.8 | 9.0 | 13.1 | 0.7 | 1.4 |
| E4Dβ-4-G11-IR | GFREGTFYDWFQAQVT | 28.9 | 9.7 | 13.6 | 0.7 | 1.4 |
| E4Dβ-4-B9-IR | GFREGNFYEWFTAQVT | 27.2 | 9.1 | 12.5 | 0.7 | 1.4 |
| E4Dβ-4-F10-IR | GFREGSFYNWFQAQVT | 7.7 | 1.5 | 2.1 | 0.7 | 1.3 |
| E4Dβ-4-D12-IR | GFREGNFYDWFVAQVT | 41.1 | 27.2 | 36.1 | 0.8 | 1.3 |
| E4Dβ-4-B8-IR | GFREGDFYDWFVAQVT | 35.9 | 27.0 | 35.2 | 0.8 | 1.3 |
| E4Dβ-4-G10-IR | GFREGAFYDWFAAQVT | 38.5 | 25.5 | 33.7 | 0.8 | 1.3 |
| E4Dβ-4-D9-IR | GFREGSFYDWFEAQVT | 34.1 | 19.3 | 25.7 | 0.8 | 1.3 |

FIG. 1I-2

| Clone Design | Sequence | Ratios over Background | | | Comparisons | |
|---|---|---|---|---|---|---|
| | | E-Tag | IGFsR | IR | IGFR/IR | IR/IGFR |
| | GFREGNFYDWFVAQVT | -- | -- | -- | -- | -- |
| E4Dβ-4-F8-IR | GFREGSFYDWFAAQVT | 39.3 | 35.6 | 44.4 | 0.8 | 1.2 |
| E4Dβ-4-E12-IR | GFREGSFYEWFDAQVT | 40.2 | 27.8 | 33.4 | 0.8 | 1.2 |
| E4Dβ-4-H12-IR | GFREGAFYDWFEAQVT | 41.2 | 27.1 | 32.3 | 0.8 | 1.2 |
| E4Dβ-4-C9-IR | GFREGQFYDWFAAQVT | 38.0 | 22.5 | 27.6 | 0.8 | 1.2 |
| E4D□-4-H9-IR | GFREGNFYDWFAAQVT | 38.7 | 33.3 | 36.6 | 0.9 | 1.1 |
| E4D□-4-G9-IR | GFREGDFYDWFAAQVT | 10.9 | 4.9 | 5.6 | 0.9 | 1.1 |
| E4Dβ-4-F12-IR | GFREGSFYEWFEAQVT | 14.8 | 5.9 | 6.1 | 1.0 | 1.0 |
| E4Dβ-4-F9-IR | GFREGGFYDWFLAQVT | 39.3 | 31.3 | 28.3 | 1.1 | 0.9 |
| E4Dβ-4-F7-IR | GFREGGFYAWFAAQVT | 31.0 | 22.2 | 19.5 | 1.1 | 0.9 |
| E4Dβ-4-B7-IR | GFREGGFYEWF?AQVT | -- | -- | -- | -- | -- |

FIG. 11-3

| Clone Design | Sequence | E-Tag | IGFsR | IR | IGFR/IR | IR/IGFR |
|---|---|---|---|---|---|---|
| E4D-2-E7-IGFR | GFREGNFYDWFYDWFVAQVT | -- | 22.8 | -- | -- | -- |
| E4D-2-C11-IGFR | GFREGDFYDWFRAQVT | 20.8 | 22.6 | -- | -- | -- |
| E4D-2-B1-IGFR | GFREGSFYDWFVAQVT | 21.5 | 22.5 | -- | -- | -- |
| E4D-2-D10-IGFR | GFREGDFYGWFQAQVT | 22.0 | 22.1 | -- | -- | -- |
| E4D-2-A9-IGFR | GFREGGFYDWFQAQVT | 20.6 | 21.5 | -- | -- | -- |
| E4D-2-E5-IGFR | GFREGDFYDWFVAQVT | 17.4 | 21.2 | -- | -- | -- |
| E4D-2-H9-IGFR | GFREGDFYDWEQAQVT | 24.2 | 20.7 | -- | -- | -- |
| E4D-1B-C4-IGFR | GFREGGFYDWFVAQVT | 19.1 | 20.5 | -- | -- | -- |
| E4D-2-E10-IGFR | GFREGDFYDWFAAQVT | 24.3 | 20.5 | -- | -- | -- |
| E4D-2-F4-IGFR | GFREGNFYDWFQAQVT | 21.0 | 20.2 | -- | -- | -- |
| E4D-2-C10-IGFR | GFREGNFYDWFLAQVT | 25.0 | 20.1 | -- | -- | -- |
| E4D-3-D8-IGFR | GFREGHFYDWFQAQVT | 22.8 | 19.8 | -- | -- | -- |
| E4D-3-F9-IGFR | GFREGQFYEWFEAQVT | 21.1 | 19.7 | -- | -- | -- |
| E4D-1B-E5-IGFR | GFREGSFYEWFQAQVT | 22.6 | 18.8 | -- | -- | -- |
| E4D-2-F3-IGFR | GFREGDFYDWFLAQVT | 24.2 | 18.0 | -- | -- | -- |
| E4D-3-D5-IGFR | GFREGHFYDWFEAQVT | 23.6 | 18.0 | -- | -- | -- |
| E4D-3-G10-IGFR | GFREGQFYEWFVAQVT | 22.2 | 17.6 | -- | -- | -- |
| E4D-2-F6-IGFR | GFREGQFYDWFVAQVT | 22.1 | 17.5 | -- | -- | -- |
| E4D-2-F7-IGFR | GFREGQFYDWFAAQVT | 24.6 | 17.5 | -- | -- | -- |
| E4D-3-B7-IGFR | GFREGNFYDWFVAQVT | 19.0 | 16.4 | -- | -- | -- |
| E4D-1B-C12-IGFR | GFRDGSFYDWFVAQVT | 23.0 | 16.1 | -- | -- | -- |
| E4D-3-B1-IGFR | GFREGHFYEWFQAQVT | 23.0 | 16.0 | -- | -- | -- |
| E4D-2-E2-IGFR | GFREGDFYDWFSAQVT | 21.6 | 14.1 | -- | -- | -- |
| E4D-2-D1-IGFR | GFREGHFYDWFDAQVT | 21.9 | 13.2 | -- | -- | -- |
| E4D-1-D4-IGFR | GFREGYFYDWFKAQVT | 24.5 | 12.4 | -- | -- | -- |
| E4D-1B-A10-IGFR | GFREGHFYDWFEAQVT | 18.9 | 10.8 | -- | -- | -- |
| E4D-1B-A3-IGFR | GFREGDFYDWFEAQVT | 23.9 | 10.8 | -- | -- | -- |
| E4D-1-B5-IGFR | GFREGTFYDWFVAQVT | 22.2 | 10.8 | -- | -- | -- |
|  | (last row) | 19.0 |  |  |  |  |

FIG. 1J-1

| Clone Design | Sequence | Ratios over Background | | | Comparisons | |
|---|---|---|---|---|---|---|
| | | E-Tag | IGFsR | IR | IGFR/IR | IR/IGFR |
| E4D-1B-B8-IGFR | GFREGNFIDMFVAQVT | -- | -- | -- | -- | -- |
| E4D-1-G7-IGFR | GFREGDYYGWFEAQVT | 23.8 | 10.7 | -- | -- | -- |
| E4D-1B-A11-IGFR | GFREGDFYAWFMAQVT | 14.3 | 10.5 | -- | -- | -- |
| E4D-1-C3-IGFR | GFREGNFYEWFLAQVT | 24.0 | 10.0 | -- | -- | -- |
| E4D-2-H1-IGFR | GFREGSFYDWFEDAQVT | 15.8 | 9.3 | -- | -- | -- |
| E4D-1-C2-IGFR | GFREGNFYDQFVAQVT | 19.6 | 4.9 | -- | -- | -- |
| E4D-1B-A12-IGFR | GFREGHFYEWFAAQVT | 11.5 | 4.5 | -- | -- | -- |
| E4D-1B-A1-IGFR | GFREGNFYEWFVAQVT | 18.4 | 3.5 | -- | -- | -- |
| E4D-2-A3-IGFR | GFREGKFYDWFVAQVT | 22.5 | 2.9 | -- | -- | -- |
| | GFREGMFDVQLLAQVT | 22.7 | 2.1 | -- | -- | -- |

FIG. 1J-2

| Clone | Sequence | Ratios over Background | | | Comparisons | |
|---|---|---|---|---|---|---|
| Design | | E-Tag | IGFsR | IR | IGFR/IR | IR/IGFR |
| Parental | XXXXXFHENEYDWFVRQVSXXXXX | -- | -- | -- | -- | -- |
| | VTFTSAVFHENFYDWFVRQVS | 29.8 | 17.5 | 16.3 | 1.1 | 0.9 |
| H2CA-4-F11-IR | TYKARFLHENFYDWFNRQVSQYFGRV | 37.7 | 2.2 | 18.1 | 0.1 | 8.2 |
| H2CA-4-E10-IR | QRLSLHEQFYDWFVGQVSPLGAGG | 31.2 | 4.4 | 18.8 | 0.2 | 4.3 |
| H2CA-4-G3-IR | GGGKVNFHEDFYGWFVQQFSGVGSDR | 36.1 | 13.4 | 25.7 | 0.5 | 1.9 |
| H2CA-3-A11-IR | LVGDAPFHEDFYDWFARQVFGCCQEQ | 35.6 | 12.1 | 22.0 | 0.5 | 1.8 |
| 12CA-4-F8-IR | TGAEVSFHENFYDWFDRQYSSWLDRD | 36.0 | 21.1 | 33.5 | 0.6 | 1.6 |
| H2CA-4-G4-IR | QPHSSRLHESFYDWFVRQVPWYALDR | 37.1 | 23.3 | 34.3 | 0.7 | 1.5 |
| H2CA-4-F4-IR | SRALAAVHEQFYDWFVRQVSGLDWGY | 39.8 | 25.0 | 35.6 | 0.7 | 1.4 |
| H2CA-4-H10-IR | QPKDGTLHENFYDWFVRQVSSGWVG | 33.5 | 5.1 | 6.6 | 0.8 | 1.3 |
| H2CA-4-F1-IR | RGRLIQLHEDFYDWFLRQVSGMGGGS | 36.1 | 19.6 | 25.1 | 0.8 | 1.3 |
| H2CA-3-D5-IR | QRGAPKSDENFYDWFVRQVLRFGEND | 39.3 | 24.3 | 31.9 | 0.8 | 1.3 |
| H2CA-4-E11-IR | AARTSLFHEDFYEWFDRQVRQEGMWG | 8.2 | 2.6 | 3.2 | 0.8 | 1.2 |
| H2CA-3-B6-IR | GTSNHSLHENFYDWFVRQLSSVQSSG | 35.9 | 9.9 | 12.1 | 0.8 | 1.2 |
| H2CA-3-A9-IR | VSHVHLFHENFYDWFVRQLAAEGFSG | 37.3 | 30.1 | 36.2 | 0.8 | 1.2 |
| H2CA-4-H5-IR | GRQDSGLHEHFYDWFSRQVQEVALG | 38.6 | 35.4 | 37.3 | 1.0 | 1.1 |
| H2CA-3-C9-IR | SNDERQFHETFYDWFVRQVSADGADR | 29.3 | 5.1 | 5.6 | 0.9 | 1.1 |
| H2CA-3-A10-IR | LSTEQRFHEKFYDWFVHQVSTSGGGT | 37.2 | 16.9 | 19.1 | 0.9 | 1.1 |
| H2CA-3-A3-IR | SLSREQFHENFYDWFARQVSELEGVV | 29.2 | 28.6 | 32.2 | 0.9 | 1.1 |
| H2CA-4-G8-IR | IPGRRSLHENFYDWFVRQVSPGGGSA | 32.4 | 29.1 | 31.6 | 0.9 | 1.1 |
| H2CA-4-G9-IR | TQKAQSLDEKFYDWFVRQVSGGGLTG | 36.1 | 34.4 | 36.4 | 0.9 | 1.1 |
| H2CA-4-G10-IR | VSQLSDFHENFYGNFARQIAGQAEWT | 34.2 | 35.5 | 37.7 | 0.9 | 1.1 |
| 12CA-4-H7-IR | NGTSQALHQNFYDWFAQQISGSEPGP | 37.0 | 36.0 | 40.0 | 0.9 | 1.1 |
| H2CA-4-F9-IR | VGQSVTFHGDFYDWFDRQLSGSQEFG | 37.5 | 36.7 | 39.5 | 0.9 | 1.1 |
| H2CA-4-F7-IR | TIDHHPLHEQFYDWFARQVSDLESLG | 37.7 | 37.6 | 39.9 | 0.9 | 1.0 |
| H2CA-3-D10-IR | PNVGYAFHENFYDWFIRQVSIEEKAG | 18.7 | 3.6 | 3.5 | 1.0 | 1.0 |
| H2CA-3-B1-IR | SRGSGVFHESFYNWFDRQVSEWIQFG | 26.5 | 21.4 | 21.5 | 1.0 | 1.0 |
| H2CA-3-A5-IR | QPVSGSVHERFYDWFVRQVSGAGGG | 32.9 | 22.9 | 22.4 | 1.0 | 1.0 |
| H2CA-4-F10-IR | ASQLPPVYENFYEWFDRQVSLDAQRE | 26.6 | 27.7 | 28.5 | 1.0 | 1.0 |

FIG. 1K-1

| Clone Design | Sequence | Ratios over Background | | | Comparisons | |
|---|---|---|---|---|---|---|
| | | E-Tag | IGFsR | IR | IGFR/IR | IR/IGFR |
| H2CA-3-D9-IR | XXXXXFHENFYDWFVRQVSXXXXXX | -- | -- | -- | -- | -- |
| H2CA-3-C2-IR | VSGRGAFHENFYDWFYDWFVRQVFRDEQDT | 36.6 | 30.6 | 30.9 | 1.0 | 1.0 |
| H2CA-4-G1-IR | ARPPPTVHENFYDWFYDWFVRQVSETWRQD | 38.3 | 30.7 | 31.0 | 1.0 | 1.0 |
| H2CA-4-E2-IR | QGGDRLFHERFYDWFDRLVSSDSTGE | 34.1 | 30.7 | 30.4 | 1.0 | 1.0 |
| H2CA-4-H9-IR | QHIAAGLHENFYDWFIRQVSGVNVPA | 33.9 | 31.0 | 31.8 | 1.0 | 1.0 |
| "2CA-3-D2-IR | QPNDGLLHENFYDWFVRQVSNAVDGG | 38.9 | 31.1 | 31.4 | 1.0 | 1.0 |
| .2CA-3-B3-IR | PVEFTVYHDNFYDWFVRQVSDGLGQF | 33.0 | 31.1 | 29.8 | 1.0 | 1.0 |
| H2CA-4-G11-IR | FCVQASIHENFYDWFVRQVAENQVFS | 35.3 | 31.4 | 30.0 | 1.0 | 1.0 |
| H2CA-4-F2-IR | GRPRGSFHENFYDWFARQVSGDGAGT | 37.9 | 31.9 | 31.0 | 1.0 | 1.0 |
| H2CA-3-C5-IR | IVGASLCHESFYDWFACQVTNLQSQG | 38.1 | 32.0 | 31.9 | 1.0 | 1.0 |
| H2CA-3-B2-IR | IGLRQMFHENFYDWFAREVSKEAGDG | 36.9 | 32.3 | 31.6 | 1.0 | 1.0 |
| H2CA-3-B11-IR | LGGAIEGHGNFYDWFVRQVSLDVGGE | 36.6 | 32.7 | 32.5 | 1.0 | 1.0 |
| H2CA-3-G2-IR | LNALQQLHENFYDWFGRQVSNTPPGG | 35.5 | 32.8 | 33.3 | 1.0 | 1.0 |
| H2CA-3-A4-IR | VGNCDTFPENFYDWFACQVSELGGMN | 35.9 | 33.0 | 33.4 | 1.0 | 1.0 |
| H2CA-3-H3-IR | FSQDGNFHENFYDWFDRQLSLVGAGT | 33.3 | 33.0 | 32.9 | 1.0 | 1.0 |
| H2CA-4-G5-IR | PAGNRALHESFYDWFVRQVSEFQLGA | 39.5 | 33.7 | 33.7 | 1.0 | 1.0 |
| H2CA-4-E8-IR | DRLRARFNENFYDWFDRQVSGQGSMP | 35.3 | 34.0 | 35.6 | 1.0 | 1.0 |
| H2CA-4-G6-IR | VLGVAQFHDKFYDWFARQVSQLESAG | 35.7 | 34.7 | 34.9 | 1.0 | 1.0 |
| H2CA-3-B7-IR | GVVGGAFHEQFYDWFDRQVSAAFKGD | 36.2 | 35.0 | 33.5 | 1.0 | 1.0 |
| H2CA-3-B4-IR | DESEMRLHEQFYDWFARLVSLEGGSA | 37.6 | 36.5 | 35.3 | 1.0 | 1.0 |
| H2CA-3-C7-IR | EGGGVAIHENFYDWFDRQVSLQGWSD | 39.8 | 36.5 | 35.1 | 1.0 | 1.0 |
| 2CA-4-E5-IR | SRIVSRFHENFYDWFVRQVSGDAPVQ | 40.2 | 36.7 | 35.9 | 1.0 | 1.0 |
| H2CA-4-E7-IR | IPAGAQLHENFYDWFARQVSGEDGGA | 37.3 | 37.0 | 36.3 | 1.0 | 1.0 |
| H2CA-3-B9-IR | GSSAAGFDEQFYDWEDRQVSEAFRDG | 39.7 | 37.6 | 37.6 | 1.0 | 1.0 |
| H2CA-4-F5-IR | RLALRTFHQDFYDWFVRQVAAEDTDP | 39.4 | 37.7 | 37.6 | 1.0 | 1.0 |
| H2CA-3-B10-IR | QGSFAVLHENFYDWFARQVSGVEGLA | 38.8 | 38.0 | 37.8 | 1.0 | 1.0 |
| H2CA-3-A12-IR | QGNMSALHENFYDWFVRQVSEADRVD | 41.9 | 38.9 | 38.0 | 1.0 | 1.0 |
| H2CA-3-A8-IR | VAYPALLHEQFYDWFVRQVSAVAGTT | 37.8 | 7.3 | 6.3 | 1.2 | 0.9 |
| | PDTINSQHKNFYDWFVRQVSGVGTSS | 36.8 | 22.5 | 19.2 | 1.2 | 0.9 |

FIG. 1K-2

| Clone Design | Sequence | Ratios over Background E-Tag | Ratios over Background IGFsR | Ratios over Background IR | Comparisons IGFR/IR | Comparisons IR/IGFR |
|---|---|---|---|---|---|---|
| | XXXXXFHENFYDWFVRQVSXXXXX | -- | -- | -- | -- | -- |
| H2CA-3-D12-IR | SEDVDSRHENFYDWFVRQVSGIGLQD | 36.8 | 34.1 | 29.6 | 1.2 | 0.9 |
| H2CA-3-B5-IR | PAPADAFDHNFYDWFARQLSATTIQ | 38.8 | 35.2 | 30.5 | 1.2 | 0.9 |
| H2CA-4-E1-IR | MVQRISIHENFYDWFVRQISGSAVPP | 29.8 | 12.5 | 11.3 | 1.1 | 0.9 |
| H2CA-3-D3-IR | GNVRGQFHGQFYDWFARQVSGSEGDA | 33.1 | 29.9 | 27.5 | 1.1 | 0.9 |
| H2CA-4-E3-IR | PDAEKQFHETFYGWFVRQISEDSANS | 33.3 | 32.3 | 30.2 | 1.1 | 0.9 |
| H2CA-4-E12-IR | FGRGVHCDENFYDWFVCQVSGALLEG | 36.0 | 32.4 | 29.4 | 1.1 | 0.9 |
| H2CA-3-A6-IR | ETPLTELHEQFYDWFVRQVSGFPGGV | 34.0 | 33.1 | 30.6 | 1.1 | 0.9 |
| H2CA-4-E9-IR | QHRGPHFHEDFYDWFVRQVSSAVPSD | 38.8 | 33.7 | 29.7 | 1.1 | 0.9 |
| H2CA-4-F3-IR | RQDPGLFHDNFYDWFDRLVSAWDGQE | 41.0 | 34.2 | 32.0 | 1.1 | 0.9 |
| H2CA-4-H6-IR | QAAVGVCNKDFYAWEACQVREDFAKA | 37.1 | 34.5 | 30.8 | 1.1 | 0.9 |
| H2CA-4-H2-IR | RNWNLQFNENFYDWFDRQVSALRGGG | 41.8 | 35.3 | 32.8 | 1.1 | 0.9 |
| H2CA-3-D4-IR | RSEQYRFHENFYEWFDRQVRQVSGQVTSG | 38.7 | 35.5 | 32.3 | 1.1 | 0.9 |
| H2CA-3-D1-IR | GAGGRDFDEDFYDWFVRQVRQVSGQVTSG | 34.5 | 35.5 | 31.3 | 1.1 | 0.9 |
| H2CA-3-C1-IR | SPEGNLVHDQFYDWFVRQLSSTSAGT | 39.9 | 36.1 | 32.9 | 1.1 | 0.9 |
| H2CA-3-D8-IR | QGGLGDFDEDFYDWFARQVSRRDRAD | 37.8 | 36.7 | 33.1 | 1.1 | 0.9 |
| H2CA-4-H4-IR | LSQGVGFQENFYEWFERQVSGWDGRD | 38.5 | 37.0 | 33.7 | 1.1 | 0.9 |
| H2CA-4-F6-IR | VFERSRCHDNFYDWFFCQVSGQADGG | 38.7 | 37.5 | 35.2 | 1.1 | 0.9 |
| H2CA-4-E4-IR | LLASRAFHENFYDWFARQVSGTQPPG | 38.6 | 38.0 | 34.7 | 1.1 | 0.9 |
| H2CA-3-C11-IR | VPDAQIFHESFYDWFVRQASAGGPAD | 40.3 | 38.3 | 36.1 | 1.1 | 0.9 |
| H2CA-3-C4-IR | ANQMGRFHDNFYDWFDRQVSRYERGT | 41.9 | 38.4 | 35.0 | 1.1 | 0.9 |
| H2CA-4-E6-IR | PSRKDGLHQSFYDWFARQVQDMEGRA | 39.3 | 38.8 | 35.8 | 1.1 | 0.9 |
| H2CA-3-D7-IR | QAVTRRFHENFYDWFARQVSEEGGWS | 42.5 | 39.2 | 35.5 | 1.1 | 0.9 |
| H2CA-3-A7-IR | GYAVGQYQANFYDWFVRQVDGMSNGG | 35.3 | 15.2 | 11.6 | 1.3 | 0.8 |
| H2CA-4-G12-IR | GHQRDLLHESFYDWFVRQVSEAEGGG | 37.6 | 19.4 | 15.1 | 1.3 | 0.8 |
| H2CA-3-D6-IR | DRPSSFIHENFYEWFARQVSQSGSSG | 39.4 | 36.2 | 27.6 | 1.3 | 0.8 |
| H2CA-4-H12-IR | ERTAETLHEQFYDWFVRQVSAMDGES | 40.0 | 38.4 | 29.3 | 1.3 | 0.8 |
| H2CA-3-D11-IR | LTSQLLSHEDFYDWFVRQVSGVGGSG | 38.1 | 32.9 | 27.2 | 1.2 | 0.8 |
| H2CA-3-C12-IR | PDRSDRLDDNFYDWFVRQVSQVINED | 38.5 | 38.4 | 31.7 | 1.2 | 0.8 |

FIG. 1K-3

| Clone | Sequence | Ratios over Background | | | Comparisons | |
|---|---|---|---|---|---|---|
| | | E-Tag | IGFsR | IR | IGFR/IR | IR/IGFR |
| Design | XXXXXFHENFYDWFVRQVSXXXXX | -- | -- | -- | -- | -- |
| H2CA-4-G7-IR | RAGGVGLHDNFYDWFVRQVSGGDSGP | 35.9 | 34.7 | 23.7 | 1.5 | 0.7 |
| H2CA-3-C6-IR | ADCYVQLHENFYDWFRRQVCNLQEGM | 38.7 | 37.6 | 28.2 | 1.3 | 0.7 |
| H2CA-3-B8-IR | RQGHAGEHDNFYDWFVRQVSGSTPQV | 37.8 | 19.6 | 9.9 | 2.0 | 0.5 |

FIG. 1K-4

FIG. 1L-1

| Clone | Sequence | Ratios over Background | | | Comparisons | |
|---|---|---|---|---|---|---|
| Design | XXXXXXFHENFYDWFVRQVSXXXXX | E-Tag | IGFsR | IR | IGFR/IR | IR/IGFR |
| Parental | VIFTSAVFHENFYDWFVRQVS | 29.8 | 17.5 | 16.3 | 1.1 | 0.9 |
| H2CA-4-G9-IGFR | GIISQSCPESFYDWFAGQVSDPWWCW | 8.6 | 9.5 | 0.6 | 16.0 | 0.1 |
| H2CA-4-H6-IGFR | VGRASGFPENFYDWFGRQLSLQSGEQ | 4.9 | 10.5 | 0.7 | 14.6 | 0.1 |
| H2CA-4-F-IGFR5 | VGYQGQGDENFYDWFIRQVSGRLGVQ | 5.5 | 9.7 | 0.8 | 12.3 | 0.1 |
| H2CA-4-H8-IGFR | SACQFDCHENFYDWFARQVSGGAAYG | 5.6 | 9.2 | 1.0 | 9.4 | 0.1 |
| H2CA-4-F11-IGFR | SAAQLFFQESFYDWELRQVAESSQPN | 3.5 | 6.8 | 1.0 | 6.7 | 0.2 |
| H2CA-4-F6-IGFR | AVRATRFDEAFYDWFVRQISDGQGNK | 3.9 | 7.3 | 1.1 | 6.4 | 0.2 |
| H2CA-4-F10-IGFR | VNQSGSIHENFYDWFERQVSHQRGVR | 4.9 | 5.7 | 1.0 | 5.9 | 0.2 |
| H2CA-1-A3-IGFR | APDPSDFQEIFYDWFVRQVSRMPGGG | 7.7 | 3.8 | 0.8 | 5.1 | 0.2 |
| H2CA-3-CB-IGFR | SSCDGAGHESFYEWFVRQVSGCRSV | 15.1 | 5.6 | 1.2 | 4.8 | 0.2 |
| H2CA-2-B9-IGFR | RAGSSDFHEDFYEWFVRQVSLSLKGK | 9.3 | 7.0 | 1.7 | 4.2 | 0.2 |
| H2CA-4-H4-IGFR | QAVQPGFHEEFYDWFVRQVSTGVGGG | 3.9 | 4.1 | 1.0 | 4.2 | 0.2 |
| H2CA-4-F7-IGFR | SSIGGGFHENFYDWFSRQLSQSPPLK | 1.5 | 3.2 | 0.8 | 4.1 | 0.2 |
| H2CA-3-D6-IGFR | QSPVGSSHEDFYDWFFRQVAQSGAHQ | 8.3 | 9.0 | 2.2 | 4.0 | 0.3 |
| H2CA-3-D8-IGFR | NYRRQVFNGNFYDWFDRQVFSLVTPG | 10.9 | 7.2 | 1.8 | 4.0 | 0.3 |
| H2CA-4-G11-IGFR | TLDGGSFEEQEFYDWFVRQLSYRTNPD | 10.8 | 9.5 | 2.5 | 3.9 | 0.3 |
| H2CA-4-F1-IGFR | FYVQQWGHENFYDWFDRQVSQSGGAG | 5.8 | 3.5 | 0.9 | 3.8 | 0.3 |
| H2CA-3-D7-IGFR | LRRQAPVEENFYDWFVRQVSGDRVGG | 13.3 | 3.0 | 0.8 | 3.7 | 0.3 |
| H2CA-1-A7-IGFR | RCGRELYHSTFYDWFDRQVAGRTCPS | 8.0 | 2.2 | 0.6 | 3.7 | 0.3 |
| H2CA-2-B4-IGFR | CCLLCRFQQNFYDWFVCQGISRLRPL | 3.5 | 4.1 | 1.1 | 3.6 | 0.3 |
| H2CA-2-B3-IGFR | PPLASDLDVQFYGWFVQQVSPPGRGG | 7.7 | 3.8 | 1.0 | 3.6 | 0.3 |
| H2CA-2-B2-IGFR | GAPVDQLHEDFYDWFVRQVSQAATG | 4.1 | 3.4 | 1.0 | 3.5 | 0.3 |
| H2CA-3-D4-IGFR | RSASGSLPEQFYDWFVRQVSLSGTDK | 17.6 | 13.8 | 4.1 | 3.4 | 0.3 |
| H2CA-4-F2-IGFR | SRVTTVFHENEYDWFVRQLSDSAISG | 9.3 | 12.8 | 4.2 | 3.0 | 0.3 |
| H2CA-3-D11-IGFR | DERGKFREDFYDWFVRQVSESRFGQ | 12.2 | 6.9 | 2.3 | 3.0 | 0.3 |
| H2CA-4-H9-IGFR | RGAVAGFHDQFYDWFDRQVSRVHKFG | 8.7 | 5.6 | 1.9 | 3.0 | 0.3 |
| H2CA-2-B11-IGFR | AICDAGFHEHFYDWFALQVSDCGRQS | 11.9 | 4.6 | 1.6 | 3.0 | 0.3 |
| H2CA-3-E8-IGFR | LGYQEPFQQNFYDWFVRQVSGAENAG | 13.2 | 6.3 | 2.2 | 2.9 | 0.3 |

| Clone Design | Sequence | Ratios over Background | | | Comparisons | |
|---|---|---|---|---|---|---|
| | | E-Tag | IGFsR | IR | IGFR/IR | IR/IGFR |
| | XXXXXXFHENFYDWFVRQVSXXXXXX | -- | -- | -- | -- | -- |
| H2CA-3-E6-IGFR | WRGHGTFHEDFYDWFVRQVSGSGSST | 15.7 | 8.7 | 3.1 | 2.8 | 0.4 |
| H2CA-4-F4-IGFR | GGRVGVLHENFYDWFVRQVSLRGADG | 11.5 | 7.4 | 3.0 | 2.5 | 0.4 |
| H2CA-3-D10-IGFR | CNLTAGFHEQFYHWFAIQVCGDAENA | 9.4 | 6.8 | 2.9 | 2.3 | 0.4 |
| H2CA-3-E1-IGFR | ERGEDMFHENFYDWFVRQISGRQGGG | 12.5 | 6.4 | 2.8 | 2.3 | 0.4 |
| H2CA-2-B6-IGFR | TNQGVGFYDSFYGWFVRQIQYGVDSG | 18.0 | 6.2 | 2.7 | 2.3 | 0.4 |
| H2CA-3-E11-IGFR | HLADGQFHEKFYDWFERQISSRCNDC | 4.7 | 2.2 | 1.0 | 2.2 | 0.5 |
| H2CA-4-H2-IGFR | QTFGKSLHENFYDWFVRQVSREEGGD | 9.8 | 9.9 | 4.8 | 2.1 | 0.5 |
| H2CA-3-C11-IGFR | FRTLAAQHDSFYDWFDRQVSGAAGER | 9.3 | 3.3 | 1.6 | 2.1 | 0.5 |
| H2CA-2-B8-IGFR | SASTHQFHENFYDWFVRQVSGAQKIL | 14.6 | 7.9 | 3.9 | 2.0 | 0.5 |

FIG. 1L-2

| Clone | Sequence | Ratios over Background | | | Comparisons | |
|---|---|---|---|---|---|---|
| Design | | E-Tag | IGFsR | IR | IGFR/IR | IR/IGFR |
| Parental | XXXXXFHDXFYAWFXXXXX | -- | -- | -- | -- | -- |
| | VTFTSAVFHENFIDWFVRQVS | 29.8 | 17.5 | 16.3 | 1.1 | 0.9 |
| H2CBα-3-B12-IR | QSDSGTVHDRFYGWFRDT*A | 26.0 | 1.3 | 20.4 | 0.1 | 16.0 |
| H2CBα-3-D2-IR | WTDVDGFHSGFYRWFQNQWER | 20.6 | 1.7 | 12.1 | 0.1 | 7.0 |
| H2CBα-3-D12-IR | VASGHVLHGQFYRWFVDQFAL | 24.6 | 2.1 | 14.0 | 0.1 | 6.7 |
| H2CBα-3-H5-IR | QARVGNVHQQFYEWFREVMQG | 16.7 | 2.4 | 15.1 | 0.2 | 6.3 |
| I2CBα-3-B6-IR | VGDFCVSHDCFYGWFLRESMQ | 31.4 | 2.5 | 13.9 | 0.2 | 5.6 |
| H2CBα-3-G11-IR | SGSRPVFHEQFYEWFVDQLG | 22.7 | 1.4 | 6.4 | 0.2 | 4.7 |
| H2CBα-3-A6-IR | QFSAGAFHGDFYGWFRALYNG | 25.9 | 1.7 | 7.1 | 0.2 | 4.3 |
| H2CBα-3-B1-IR | SRFDERLHHQFYEWFRVLNEP | 33.4 | 6.0 | 25.5 | 0.2 | 4.3 |
| H2CBα-3-F8-IR | DSVNSDLHRAFYGWFAEQWRA | 23.0 | 4.8 | 19.8 | 0.2 | 4.1 |
| H2CBα-3-E11-IR | GSVDREIHGPFYSWFSEQLWG | 14.0 | 2.2 | 8.5 | 0.3 | 4.0 |
| H2CBα-3-G4-IR | SAKTPVLHDGFYMWFEAQSES | 24.9 | 2.2 | 6.9 | 0.3 | 3.2 |
| H2CBα-3-D3-IR | LVVGRRFHQSFYDWFVAAAGG | 23.6 | 2.6 | 8.0 | 0.3 | 3.1 |
| H2CBα-3-C1-IR | IMWPCTFQDPFYCWFQTEQGR | 27.0 | 5.6 | 16.4 | 0.3 | 2.9 |
| H2CBα-3-C3-IR | VVGPLDIHERFYGWFHQQGGA | 23.3 | 1.1 | 3.1 | 0.4 | 2.8 |
| H2CBα-3-G3-IR | VVPKAGFHEAFYEWFRRQDRD | 23.7 | 6.7 | 17.6 | 0.4 | 2.6 |
| H2CBα-3-E4-IR | QSFVTSVHTRFYAWFASALEM | 28.8 | 8.3 | 21.9 | 0.4 | 2.6 |
| H2CBα-3-G5-IR | SRGLGLYHSGFYGWFERQFNQ | 26.7 | 7.0 | 17.2 | 0.4 | 2.5 |
| H2CBα-3-B11-IR | GADTGAVHRRFYLMFEQLSGG | 28.0 | 8.6 | 19.4 | 0.4 | 2.3 |
| H2CBα-3-A1-IR | PGNRPTFHAEFYRWFREAQGS | 31.3 | 11.3 | 24.9 | 0.5 | 2.2 |
| H2CBα-3-H1-IR | VAVAWGLHESFYAWFFENQFSD | 27.2 | 10.6 | 23.9 | 0.4 | 2.2 |
| H2CBα-3-F12-IR | GFNTGTFHDQFYYWFWEAAGG | 21.1 | 6.1 | 12.7 | 0.5 | 2.1 |
| H2CBα-3-H7-IR | GDGLTAFHQGFYEWFDIQMYG | 21.0 | 9.7 | 19.1 | 0.5 | 2.0 |
| H2CBα-3-C12-IR | VGVNRQFHTRFYAWFDEQLGG | 26.0 | 12.7 | 24.7 | 0.5 | 1.9 |

FIG. 1M-1

| Clone Design | Sequence XXXXXFHXXFYXWFXXXXX | Ratios over Background | | | Comparisons | |
|---|---|---|---|---|---|---|
| | | E-Tag | IGFoR | IR | IGFR/IR | IR/IGFR |
| H2CBα-3-D11-IR | GPRGQRLHDAFYSWFDALRVN | 27.8 | 13.0 | 24.8 | 0.5 | 1.9 |
| H2CBα-3-H12-IR | LGTLAVFHELFYGWFERQLGG | 27.4 | 7.2 | 12.4 | 0.6 | 1.7 |
| H2CBα-3-A10-IR | LGGYCGFNCQFYRWFDNLADR | 27.1 | 13.2 | 22.3 | 0.6 | 1.7 |
| H2CBα-3-A5-IR | FSGWADYQSGFYQWFAEELAN | 28.3 | 16.1 | 28.1 | 0.6 | 1.7 |
| H2CBα-3-C4-IR | WGPFSVFDESFYRWFAQASDD | 30.7 | 17.2 | 29.2 | 0.6 | 1.7 |
| H2CBα-3-B8-IR | PRNEGLVHGLFYDWFQRALSG | 25.6 | 11.3 | 18.6 | 0.6 | 1.6 |
| H2CBα-3-H11-IR | DEGGAPLDVMFYRWFEQAVRG | 28.8 | 14.0 | 22.4 | 0.6 | 1.6 |
| H2CBα-3-E10-IR | QSGNRGSHGAFYSWFRDVLAN | 27.7 | 14.3 | 23.0 | 0.6 | 1.6 |
| H2CBα-3-C2-IR | MRQRDGFNSSFYGWFAAALGE | 28.4 | 17.0 | 26.7 | 0.6 | 1.6 |
| H2CBα-3-F6-IR | SEERKKVHSQFYSWFDRQLLG | 27.3 | 14.5 | 21.8 | 0.7 | 1.5 |
| H2CBα-3-D4-IR | PSPNAPFHGGFYDWFDWVQGS | 29.0 | 18.9 | 27.1 | 0.7 | 1.4 |
| H2CBα-3-A7-IR | EHRPGSFNTNFYQWFDDQMNQ | 29.1 | 19.4 | 26.9 | 0.7 | 1.4 |
| H2CBα-3-H4-IR | SDDSTLNGRFYTWFHMQLLD | 27.2 | 20.1 | 27.9 | 0.7 | 1.4 |
| H2CBα-3-B7-IR | QRGGGGFHEGFYSWFRSQSLL | 28.6 | 18.0 | 23.6 | 0.8 | 1.3 |
| H2CBα-3-F9-IR | SGSRPVFHEQFYEWFVDQLGL | 26.1 | 19.1 | 24.3 | 0.8 | 1.3 |
| H2CBα-3-H6-IR | GGSSQAFHGAFYEWFSAQLRG | 24.8 | 21.6 | 27.3 | 0.8 | 1.3 |
| H2CBα-3-F5-IR | AFVSERVNQRFYDWFRDQMRS | 29.4 | 22.0 | 27.8 | 0.8 | 1.3 |
| H2CBα-3-A2-IR | VRHPTREFHDEFYRWFTEQLTT | 30.7 | 22.5 | 29.1 | 0.8 | 1.3 |
| H2CBα-3-F3-IR | ARLLNIFDRGFYNWFQRQLDE | 16.3 | 6.7 | 9.0 | 0.7 | 1.3 |
| H2CBα-3-G6-IR | PSLSSNLHESFYRWFDQLVST | 24.9 | 21.0 | 24.4 | 0.9 | 1.2 |
| H2CBα-3-G7-IR | FAFGLGFHQGFYDWFAHQLEG | 24.4 | 18.7 | 23.0 | 0.8 | 1.2 |
| H2CBα-3-C5-IR | VSATVMLHREFYDWFGLQLLD | 26.4 | 21.2 | 25.4 | 0.8 | 1.2 |
| H2CBα-3-G1-IR | GGVSGVLHDRFYSWFERQLAG | 26.9 | 21.5 | 26.3 | 0.8 | 1.2 |
| H2CBα-3-E3-IR | GLGIASFHEGFYSWFTAQLGA | 24.2 | 17.2 | 19.3 | 0.9 | 1.1 |

FIG. 1M-2

| Clone D sign | Sequence | Ratios over Background | | | Comparisons | |
|---|---|---|---|---|---|---|
| | | E-Tag | IGF6R | IR | IGFR/IR | IR/IGFR |
| | XXXXXXFHXXFYXWFXXXXXX | -- | -- | -- | -- | -- |
| H2CBα-3-A9-IR | RVDAAALNAGFYEWFRGVIQG | 30.5 | 21.7 | 24.1 | 0.9 | 1.1 |
| H2CBα-3-C11-IR | GGAGRSFHDAFYEWFERQMAG | 26.4 | 21.8 | 23.2 | 0.9 | 1.1 |
| H2CBα-3-B4-IR | EGARQGFHARFYSWFAQQLAL | 30.9 | 22.0 | 24.3 | 0.9 | 1.1 |
| H2CBα-3-F11-IR | VLLPGVVHGGFYDWFSRQLSS | 24.5 | 22.5 | 23.9 | 0.9 | 1.1 |
| H2CBα-3-G10-IR | GALSDRYNNVFYDWFREQLLG | 28.3 | 23.6 | 27.1 | 0.9 | 1.1 |
| H2CBα-3-D7-IR | PDSFMSLHQRFYSWFQAQVGT | 31.4 | 23.6 | 25.3 | 0.9 | 1.1 |
| H2CBα-3-E2-IR | RVYKANFHNEFYGWFREQLLG | 26.8 | 24.0 | 25.7 | 0.9 | 1.1 |
| H2CBα-3-B5-IR | HSGMRDVHARFYSWFSEQLSG | 28.7 | 25.0 | 26.4 | 0.9 | 1.1 |
| H2CBα-3-C7-IR | ARLLERFQDPFYEWFFETLMGD | 30.0 | 25.2 | 28.7 | 0.9 | 1.1 |
| H2CBα-3-G9-IR | RNSSGNFHDKFYNWFEAQLKG | 27.8 | 25.2 | 26.7 | 0.9 | 1.1 |
| H2CBα-3-A12-IR | GSMSPVFNDQFYGWFRDLVDE | 28.0 | 26.4 | 28.7 | 0.9 | 1.1 |
| H2CBα-3-C9-IR | SCTGRQFDGCFYAWFEDQLVG | 32.1 | 28.7 | 31.9 | 0.9 | 1.1 |
| H2CBα-3-B10-IR | GIAVQSLHDSFYRWFDNALGS | 33.5 | 30.8 | 33.2 | 0.9 | 1.0 |
| H2CBα-3-E1-IR | IGPPGSLHRGFYDWFAEQVEA | 31.7 | 30.5 | 29.0 | 1.1 | 1.0 |
| H2CBα-3-G12-IR | GAAGISFHRGFYDWFAAQVRD | 29.1 | 31.4 | 29.8 | 1.1 | 1.0 |
| H2CBα-3-F7-IR | GVDVTDFHKDFYSWFQRQLNG | 23.2 | 20.7 | 20.3 | 1.0 | 1.0 |
| H2CBα-3-G8-IR | WAGRAGIHGGFYEWFNRQLRG | 22.8 | 20.9 | 20.4 | 1.0 | 1.0 |
| H2CBα-3-C6-IR | LGQLAAFHLGFYEWFSEAVAA | 26.7 | 21.2 | 22.0 | 1.0 | 1.0 |
| H2CBα-3-H9-IR | VHSVSRLNVGFYQWFQDQLSG | 23.4 | 22.5 | 22.0 | 1.0 | 1.0 |
| H2CBα-3-H8-IR | LGLMAIFDRGFYGWFEQQLSG | 23.5 | 23.4 | 23.2 | 1.0 | 1.0 |
| H2CBα-3-F2-IR | VARGSSLHDDFYEWFASQLRT | 25.5 | 24.3 | 25.2 | 1.0 | 1.0 |
| H2CBα-3-D5-IR | LGYIGALNTQFYSWFADLVGS | 26.7 | 24.5 | 25.6 | 1.0 | 1.0 |
| H2CBα-3-D10-IR | EDSRLRLHEGFYGWFRKQLGD | 26.8 | 24.9 | 24.9 | 1.0 | 1.0 |
| H2CBα-3-F10-IR | GRDNMKFHSGFYDWFTQQLAG | 25.7 | 25.6 | 26.1 | 1.0 | 1.0 |

FIG. 1M-3

| Clone Design | Sequence XXXXXXFHXXFYXWFXXXXX | Ratios over Background | | | Comparisons | |
|---|---|---|---|---|---|---|
| | | E-Tag | IGFaR | IR | IGFR/IR | IR/IGFR |
| H2CBα-3-D6-IR | AGVMGGFHQEFYLWFERALSN | 27.9 | 26.0 | 25.8 | 1.0 | 1.0 |
| H2CBα-3-H3-IR | AGHVGQVYDGFYGWFREQLGA | 27.0 | 26.9 | 26.2 | 1.0 | 1.0 |
| 42CBα-3-F4-IR | FVQNIGFDYDGFYGWFVREVEK | 31.2 | 27.2 | 27.7 | 1.0 | 1.0 |
| H2CBα-3-E9-IR | PVGIGGLHRAFYQWFQSQVDA | 31.6 | 27.7 | 28.2 | 1.0 | 1.0 |
| H2CBα-3-H10-IR | GSRQEADHQAFYDWFNLVLGV | 26.9 | 27.9 | 28.8 | 1.0 | 1.0 |
| H2CBα-3-G2-IR | AGGRKPFHDDFYGWFRDQLAE | 29.1 | 28.1 | 28.8 | 1.0 | 1.0 |
| H2CBα-3-B2-IR | DLASHGFHDAFYNWFSVQLNS | 29.4 | 28.1 | 28.2 | 1.0 | 1.0 |
| H2CBα-3-E8-IR | GSNGGGVHGQFYAWFVEALSG | 31.5 | 28.4 | 29.1 | 1.0 | 1.0 |
| H2CBα-3-E5-IR | RGRASTFHDGFYGWFSQQLRF | 33.0 | 28.7 | 28.9 | 1.0 | 1.0 |
| H2CBα-3-E6-IR | SPARRVSHHDFYGWFAKQLES | 29.6 | 29.0 | 28.1 | 1.0 | 1.0 |
| H2CBα-3-E7-IR | SSDVGAFHSAFYDWFKAQLSG | 30.4 | 30.2 | 30.2 | 1.0 | 1.0 |
| H2CBα-3-C8-IR | PTVHRAFDDLFYGWFAKQVED | 31.9 | 31.2 | 31.5 | 1.0 | 1.0 |
| H2CBα-3-A4-IR | SSNTVGLDERFYAWFVDQLGA | 32.2 | 31.9 | 32.6 | 1.0 | 1.0 |
| H2CBα-3-D1-IR | PGAAEGFHSAFYDWFAQAVSG | 32.9 | 32.5 | 31.5 | 1.0 | 1.0 |
| H2CBα-3-B9-IR | MRSEASFHVEFYSWFEEQLRS | 33.2 | 33.8 | 33.3 | 1.0 | 1.0 |
| H2CBα-3-D8-IR | VSRYGGQQDGFYHWFSDLLKG | 26.3 | 20.2 | 19.1 | 1.1 | 0.9 |
| I2CBα-3-F1-IR | RPSSGGLHYGFYHWFRVQEEM | 28.8 | 28.0 | 26.4 | 1.1 | 0.9 |
| H2CBα-3-A11-IR | SNIEEHFHMQFYRWFSDALGN | 20.5 | 21.5 | 17.7 | 1.2 | 0.8 |
| H2CBα-3-A3-IR | ANDCLGLHAGFYGWFACQLGG | 30.4 | 29.6 | 21.8 | 1.4 | 0.7 |

FIG. 1M-4

| Clone Design | Sequence XXXXXXFHXXFYXWFXXXXX | Ratios over Background | | | Comparisons | |
|---|---|---|---|---|---|---|
| | | E-Tag | IGFsR | IR | IGFR/IR | IR/IGFR |
| H2CBβ-3-E8-IR | TGHRLGLDEQFYWWFRDALSG | 15.9 | 1.9 | 11.8 | 0.2 | 6.1 |
| I2CBβ-4-F8-IR | VLTSNTLHQRFYSWFAAARRE | 13.4 | 0.8 | 2.6 | 0.3 | 3.4 |
| H2CBβ-3-C4-IR | CVAQGGFQSSFYCWFAGLDID | 21.1 | 1.3 | 4.0 | 0.3 | 3.1 |
| H2CBβ-3-D5-IR | NGQSSRFHTAFYDWFAAQLSG | 14.0 | 3.3 | 10.2 | 0.3 | 3.1 |
| H2CBβ-3-E6-IR | SVPRGTVHDAFYQWFREVALG | 5.7 | 0.7 | 2.1 | 0.3 | 3.1 |
| H2CBβ-4-G12-IR | GARGSTFHDQFYEWFNVQLGD | 6.8 | 1.8 | 5.4 | 0.3 | 3.1 |
| H2CBβ-4-F4-IR | PPGMNGFHTSFYSWFVDQLGD | 17.9 | 1.9 | 5.6 | 0.3 | 3.0 |
| H2CBβ-4-F11-IR | AVGTLGYHSGFYRWFERQLGG | 15.0 | 1.7 | 4.8 | 0.3 | 2.9 |
| H2CBβ-3-E5-IR | ELQARGVHRNFYRWFEAQVSG | 17.0 | 1.8 | 5.0 | 0.4 | 2.8 |
| H2CBβ-4-F2-IR | HRVARAFHEQFYDWFEKAVSG | 15.9 | 1.3 | 3.4 | 0.4 | 2.6 |
| H2CBβ-4-G4-IR | GAMEPDYHRSFYQWFAAALGE | 8.7 | 1.4 | 3.5 | 0.4 | 2.6 |
| H2CBβ-3-C8-IR | CPDRQSVDDRFYNWFADALAS | 4.9 | 1.4 | 3.2 | 0.4 | 2.3 |
| H2CBβ-4-F10-IR | GGAQISFHERFYQWFLQEAAG | 10.2 | 1.0 | 2.4 | 0.4 | 2.3 |
| H2CBβ-4-H4-IR | HKRGIVQHGAFYAWFDSLLSG | 20.8 | 4.2 | 9.5 | 0.4 | 2.3 |
| H2CBβ-4-G6-IR | QASDNRSDGQFYLWFEKLLSS | 14.5 | 5.6 | 8.5 | 0.7 | 1.5 |
| H2CBβ-4-H1-IR | DRGRMGVDEGFYNWFARQMQE | 17.0 | 10.1 | 13.2 | 0.8 | 1.3 |

FIG. 1M-5

| Clone Design | Sequence | Ratios over Background | | | Comparisons | |
|---|---|---|---|---|---|---|
| | | E-Tag | IGFaR | IR | IGFR/IR | IR/IGFR |
| Parental | XXXXXXFHXXFYXWFXXXXX | -- | -- | -- | -- | -- |
| | VTFTSAVFHENFYDWFVRQVS | 29.8 | 17.5 | 16.3 | 1.1 | 0.9 |
| H2CB-3-D2-IGFR | TASQECFDDGFYGWFRAWRCT | 22.9 | 18.6 | 11.8 | 1.6 | 0.6 |
| H2CB-3-C12-IGFR | SLDWRWSEEPFYRWFQRALAG | 17.3 | 19.6 | 13.0 | 1.5 | 0.7 |
| H2CB-3-B11-IGFR | CMSLSDCHRKFYGWFKSQGGE | 24.6 | 17.1 | 11.9 | 1.4 | 0.7 |
| H2CB-4-E2-IGFR | LALCRRSPGSFYGWFQAAVGC | 22.4 | 21.0 | 16.5 | 1.3 | 0.8 |
| H2CB-3-A5-IGFR | PRSATMSDGGFYWWFASQLGL | 28.8 | 26.1 | 22.6 | 1.2 | 0.9 |
| H2CB-4-G12-IGFR | LRRSSVFHDPFYE*ISRLVGG | 23.7 | 23.8 | 19.4 | 1.2 | 0.8 |
| H2CB-3-B2-IGFR | ARLQQQFHGGFYEWFRAQVSP | 23.0 | 19.9 | 16.4 | 1.2 | 0.8 |
| H2CB-3-D1-IGFR | AQLDNLCHEPFYSWFCAVTRE | 21.5 | 19.5 | 15.7 | 1.2 | 0.8 |
| H2CB-3-B6-IGFR | WTCDTAFHQDFYQWFCDKLGV | 16.3 | 4.5 | 3.7 | 1.2 | 0.8 |
| H2CB-3-F7-IGFR | GKEGFGLDRDFYWWFREQLGP | 22.0 | 19.0 | 18.0 | 1.1 | 0.9 |
| H2CB-3-G8-IGFR | GRAPSSFDCDFYCWFRNQVQS | 20.2 | 18.6 | 16.5 | 1.1 | 0.9 |
| H2CB-3-D4-IGFR | DVEAETQHRLFYAWFLSQLGS | 21.9 | 18.3 | 16.9 | 1.1 | 0.9 |
| H2CB-3-D5-IGFR | ISVTAVFHDGFYGWFNEQVSK | 21.4 | 17.9 | 16.4 | 1.1 | 0.9 |
| H2CB-3-E6-IGFR | NSEHGRLDVDFYGWFARVIQQ | 19.6 | 15.8 | 14.8 | 1.1 | 0.9 |
| H2CB-3-C2-IGFR | GPLGDGCQDGFYGWFMCQVST | 18.8 | 12.2 | 10.8 | 1.1 | 0.9 |
| H2CB-3-A6-IGFR | KRSAYNFHDPFYDWFRMQLSG | 26.8 | 29.0 | 28.1 | 1.0 | 1.0 |
| H2CB-4-H12-IGFR | ASEPGGYLDPFYGWFREQLRA | 23.9 | 28.3 | 28.1 | 1.0 | 1.0 |
| H2CB-3-B10-IGFR | NRGDGGVHSGFYNWFRLQLSG | 27.1 | 27.5 | 27.3 | 1.0 | 1.0 |
| H2CB-4-F11-IGFR | ASKGSSLHNDFYGWFAQQLAR | 25.5 | 25.5 | 24.6 | 1.1 | 1.0 |
| H2CB-4-G11-IGFR | ANVSMWIQVGFYDWFDAQLRQ | 25.3 | 25.4 | 25.3 | 1.0 | 1.0 |
| H2CB-4-E12-IGFR | RTSPGSLHDPFYDWFQQQLGG | 27.8 | 24.9 | 24.7 | 1.0 | 1.0 |
| H2CB-4-G10-IGFR | PGVMSSFHGGFYSWFREQLNG | 25.1 | 24.6 | 24.2 | 1.0 | 1.0 |
| H2CB-3-B9-IGFR | CLANSEDHDSFYGWFCQALGG | 25.6 | 23.3 | 23.7 | 1.0 | 1.0 |
| H2CB-3-B7-IGFR | GGSMGGMHGSFYEWFALQLRS | 24.0 | 23.2 | 23.5 | 1.0 | 1.0 |
| H2CB-4-H4-IGFR | RPQGGSIHAGFYQWFRDAVAG | 23.5 | 23.1 | 23.8 | 1.0 | 1.0 |

FIG. 1N-1

| Clone Design | Sequence XXXXXFHXFYXWFXXXXX | Ratios over Background E-Tag | IGFaR | IR | Comparisons IGFR/IR | IR/IGFR |
|---|---|---|---|---|---|---|
| H2CB-4-H10-IGFR | GALSSLFDAAFYDWFNRQLEG | 21.9 | 22.4 | 23.3 | 1.0 | 1.0 |
| H2CB-4-H5-IGFR | KVDLRGFHDGFYGWFARQLAG | 22.3 | 22.3 | 21.6 | 1.0 | 1.0 |
| H2CB-4-G7-IGFR | CSGLQRCHDSFYSWFESVVRE | 23.1 | 21.6 | 20.6 | 1.0 | 1.0 |
| H2CB-4-F4-IGFR | DSLGISFHEGFYDWFRRQLDM | 21.3 | 20.9 | 21.3 | 1.0 | 1.0 |
| H2CB-3-D8-IGFR | SGVFNGTFYDWFRIQLGE | 20.0 | 20.5 | 21.6 | 1.0 | 1.0 |
| H2CB-4-E4-IGFR | GYREMRSDLGFYQWFRDQLGL | 21.6 | 20.5 | 21.2 | 1.0 | 1.0 |
| H2CB-4-E5-IGFR | SVFMQHDHVGFYAWFRSLMEE | 22.0 | 19.9 | 20.9 | 1.0 | 1.0 |
| H2CB-4-E8-IGFR | FRHITEVDRSFYGWFVEQLRG | 21.1 | 19.7 | 20.7 | 1.0 | 1.0 |
| H2CB-3-D12-IGFR | WAGGSDVDGSFYDWFQRLLAS | 26.6 | 17.3 | 16.8 | 1.0 | 1.1 |
| H2CB-4-G9-IGFR | GLQNVSFHSGFYENFARQVSQ | 21.6 | 14.5 | 15.2 | 1.0 | 1.1 |
| H2CB-3-C8-IGFR | SRVSDPYHVGFYQWFEEVVRG | 20.8 | 13.4 | 13.9 | 1.0 | 1.0 |
| H2CB-3-A12-IGFR | MGGATFFHTGFYDWFAAQLQH | 28.6 | 27.5 | 29.2 | 0.9 | 1.1 |
| H2CB-3-B12-IGFR | RPASRPFHSGFYQWFADQLSH | 27.8 | 25.2 | 27.1 | 0.9 | 1.1 |
| H2CB-3-A9-IGFR | GLAPGNFHEDFYRWFQEQTLG | 27.7 | 24.3 | 25.7 | 0.9 | 1.1 |
| H2CB-3-A3-IGFR | TAAISDFNSLFYGWFEQLLSS | 26.9 | 24.1 | 26.5 | 0.9 | 1.1 |
| H2CB-3-B4-IGFR | LDEDLPQHAGFYGWFAEALGV | 25.8 | 23.8 | 25.3 | 0.9 | 1.1 |
| H2CB-3-E7-IGFR | ASHKSAFDDNFYRWFSMQLRD | 24.6 | 21.6 | 24.0 | 0.9 | 1.1 |
| H2CB-4-G6-IGFR | HTGAGDLHGAFYNWFLEQLGG | 22.4 | 21.1 | 23.0 | 0.9 | 1.1 |
| H2CB-4-E9-IGFR | RRGRDGFHGGFYDWFAAQLSD | 24.3 | 20.7 | 22.0 | 0.9 | 1.1 |
| H2CB-4-H2-IGFR | GNFREAFHADFYSWFERQLQS | 21.6 | 20.2 | 21.9 | 0.9 | 1.1 |
| H2CB-3-A10-IGFR | RDTLPAFHQHFYQWFEKQVSA | 24.3 | 19.9 | 21.5 | 0.9 | 1.1 |
| H2CB-3-C4-IGFR | ERETAAFGQAFYQWFRDQIAG | 23.1 | 19.2 | 22.0 | 0.9 | 1.1 |
| H2CB-3-B5-IGFR | WGEGGGFYDWFYDQLGWEPSH | 24.2 | 18.8 | 20.7 | 0.9 | 1.1 |
| H2CB-4-G4-IGFR | SLVAADLHEGFYGWFRSQLGG | 21.7 | 18.7 | 21.2 | 0.9 | 1.1 |
| H2CB-3-D9-IGFR | TSEVGDFHAEFYSWFEIQLGR | 24.4 | 18.6 | 20.0 | 0.9 | 1.1 |
| H2CB-3-C3-IGFR | TGADGLLHARFYAWFEEQLRE | 20.3 | 18.4 | 21.1 | 0.9 | 1.1 |
| H2CB-3-D3-IGFR | RRSDSSLHRSFYDWFSVQLLN | 22.5 | 18.3 | 21.3 | 0.9 | 1.2 |
| H2CB-4-F2-IGFR | SESKYLLHSGFYGWFEAQLRG | 18.0 | 16.8 | 18.3 | 0.9 | 1.1 |

FIG. 1N-2

| Clone Design | Sequence xxxxxFHxxFYxWFxxxxx | Ratios over Background | | | Comparisons | |
|---|---|---|---|---|---|---|
| | | E-Tag | IGFaR | IR | IGFR/IR | IR/IGFR |
| H2CB-4-H1-IGFR | HGVIRADHTGFYGWFSKQLSD | 18.3 | 15.3 | 16.5 | 0.9 | 1.1 |
| H2CB-4-F9-IGFR | LINA.VFRRGFYAWFEEQVSK | 22.9 | 14.4 | 15.3 | 0.9 | 1.1 |
| H2CB-4-E10-IGFR | LQRYIGFHDPFYDWFSRALSG | 26.1 | 20.1 | 24.5 | 0.8 | 1.2 |
| H2CB-4-F8-IGFR | MRTAELFHVGFYDWFDAQLMD | 21.5 | 14.8 | 19.0 | 0.8 | 1.3 |
| H2CB-3-A8-IGFR | WAPPDALHGQFYRWFQRQLDQ | 20.7 | 14.7 | 18.2 | 0.8 | 1.2 |
| H2CB-4-F1-IGFR | AVHAATFHDDFYRWFEQVVGS | 22.2 | 14.6 | 18.8 | 0.8 | 1.3 |
| H2CB-3-C6-IGFR | FDAVHGFDGGFYGWFKRELQR | 15.7 | 7.8 | 10.2 | 0.8 | 1.3 |
| H2CB-4-E11-IGFR | QAGGMEFHGAFYNWFLQQLSG | 26.1 | 17.6 | 24.1 | 0.7 | 1.4 |
| H2CB-3-D6-IGFR | GRSVSRMNAEFYQWFGHQLAA | 21.6 | 13.0 | 18.8 | 0.7 | 1.5 |
| H2CB-4-F3-IGFR | AAVNSLFHDEFYLWFQDQLDG | 17.3 | 11.1 | 16.4 | 0.7 | 1.5 |
| H2CB-3-A4-IGFR | QLGMDWFHADFYEWFLAQLPS | 27.4 | 11.0 | 14.8 | 0.7 | 1.3 |
| H2CB-3-B1-IGFR | RLAGSGIHEGFYGWFVDQLLA | 20.0 | 11.0 | 15.2 | 0.7 | 1.4 |
| H2CB-3-C5-IGFR | GREIGGVHDGFYDWFRQOSEQ | 19.9 | 10.5 | 15.6 | 0.7 | 1.5 |
| H2CB-4-F6-IGFR | VRSEQRFDSSFYQWFNDLLMS | 18.6 | 10.1 | 14.6 | 0.7 | 1.4 |
| H2CB-3-B8-IGFR | QSPYGFFHDGFYRWFLQQTGM | 20.7 | 6.9 | 9.5 | 0.7 | 1.4 |
| H2CB-3-C7-IGFR | FQCGAAFHVDFYRWFTCQEQF | 16.2 | 1.8 | 2.5 | 0.7 | 1.4 |
| H2CB-4-H7-IGFR | GAFGSEFHEQFYRWFEDALSF | 21.8 | 14.1 | 22.7 | 0.6 | 1.6 |
| H2CB-4-F5-IGFR | EHTSYQIHRQFYEWFDRALGR | 12.9 | 4.0 | 7.2 | 0.6 | 1.8 |
| H2CB-4-G1-IGFR | SGTAADLHSRFYGWFALQARE | 20.4 | 10.3 | 19.7 | 0.5 | 1.9 |
| H2CB-3-D11-IGFR | EGFGVLFHGQFYRWFQLQLDG | 24.1 | 8.8 | 18.6 | 0.5 | 2.1 |
| H2CB-3-D7-IGFR | QOSAGHPHSSFYLWFSELLGA | 22.1 | 6.5 | 13.6 | 0.5 | 2.1 |
| H2CB-3-C10-IGFR | YLQRAGFHRSFYGWFDQALRD | 21.7 | 5.1 | 10.4 | 0.5 | 2.0 |
| H2CB-4-E3-IGFR | MWLWATLHSDFYSWFEQVVSG | 20.3 | 4.6 | 8.9 | 0.5 | 1.9 |
| H2CB-3-C1-IGFR | GANALGFKDRFYEWFAAQLWD | 22.3 | 6.7 | 15.7 | 0.4 | 2.3 |
| H2CB-4-G2-IGFR | GSGLYVFHWGFYDWFEEQMGG | 19.9 | 3.3 | 10.7 | 0.3 | 3.3 |
| H2CB-3-A11-IGFR | LDKGWGFDLQFYRWFEAATRA | 23.9 | 2.5 | 7.7 | 0.3 | 3.1 |
| H2CB-4-G5-IGFR | QRSAVEFHADFYDWFLRLLTP | 19.3 | 2.5 | 7.9 | 0.3 | 3.1 |
| H2CB-4-F12-IGFR | DQRMGSFHGEEFYRWFEETLLS | 16.7 | 1.7 | 5.4 | 0.3 | 3.1 |

FIG. 1N-3

| Clone Design | Sequence $X_n$-FYxWF-$X_n$ | Ratios over Background | | | Comparisons | |
|---|---|---|---|---|---|---|
| | | E-Tag | IGFsR | IR | IGFR/IR | IR/IGFR |
| 20E2A-3-B11-IR | GRFYGWEQDAIDQLMPWGFDP | 24.6 | 1.4 | 23.6 | 0.1 | 16.8 |
| 20E2Bβ-3-E3-IR | IQGWEPFYGWFDDVVAQMFEE | 23.0 | 0.9 | 15.3 | 0.1 | 16.3 |
| rB6-3-F6-IR | RYGRWGLAQQFYDWFDR | 40.9 | 1.0 | 13.3 | 0.1 | 13.3 |
| rB6-4-F9-IR | RGRLGSLSTQFYNWFAE | 34.1 | 1.0 | 12.6 | 0.1 | 12.6 |
| 20E2Bα-3-A8-IR | ASAYTPFYQWFADVVSEYMQQ | 35.4 | 7.4 | 34.4 | 0.2 | 4.6 |
| A6L-4-F6-IR | PYRMEGTEKWNFYDWFVAQLQ | 28.9 | 4.1 | 18.1 | 0.2 | 4.4 |
| 20E2Bα-4-H9-IR | SAVHFQFYKWFDNLLPVPLSA | 37.8 | 9.4 | 26.7 | 0.4 | 2.9 |
| 20E2Bβ-3-B1-IR | VPVNKSFYRWFQLVLGGSDDW | 41.8 | 12.9 | 36.8 | 0.4 | 2.9 |
| 20E2Bα-4-F9-IR | QSPRASFYGWFDDVLRAAGVV | 25.9 | 4.2 | 10.1 | 0.4 | 2.4 |
| 20E2Bβ-3-E9-IR | TGFYEWFYEQLHSRMLPNPLD | 27.0 | 7.7 | 17.2 | 0.5 | 2.2 |
| 20E2Bβ-3-E10-IR | RRGVGGFYGWFSQQLQGMGVA | 22.2 | 2.6 | 5.5 | 0.5 | 2.1 |
| 20E2Bα-3-C12-IR | SSQDRRFYRWFEQAIVGGRDG | 39.0 | 6.7 | 12.0 | 0.6 | 1.8 |
| 20E2Bβ-3-C12-IR | TRGQLGFYNWFQQALSTSGMG | 20.2 | 2.2 | 3.8 | 0.6 | 1.8 |
| 20E2Bβ-3-E7-IR | CADLNAFYQWFCGVLDRGSDH | 9.2 | 1.2 | 1.9 | 0.6 | 1.6 |
| 20E2Bβ-3-E11-IR | TLIQDQFYWWFSDLLSAEPGD | 20.7 | 1.3 | 2.1 | 0.6 | 1.6 |
| 20E2Bα-3-B11-IR | IDQLDAFYRWFDGVMLGMGDP | 36.0 | 20.7 | 32.8 | 0.6 | 1.6 |
| NNKH-4-G2-IR | RGGGTFYEWFESALRKHGAG | 10.8 | 6.3 | 8.9 | 0.7 | 1.4 |
| 0E2Bα-3-A7-IR | RGLDQDFYRWFQNLVGVEYDR | 19.0 | 4.2 | 5.5 | 0.8 | 1.3 |
| 20E2Bα-4-G12-IR | MQGHRGFYGWFARVLEQDRGW | 37.0 | 22.3 | 29.5 | 0.8 | 1.3 |
| 20E2Bα-3-C11-IR | ERLHLRFYEWFDTVIGQDGSD | 37.3 | 26.8 | 34.8 | 0.8 | 1.3 |
| 20E2Bα-3-C10-IR | MHVQSDFYHWFQSLLGQGGPD | 37.7 | 24.8 | 30.5 | 0.8 | 1.2 |

FIG. 10-1

| Clone Design | Sequence X_-FyxWF-x_ | Ratios over Background | | | Comparisons | |
|---|---|---|---|---|---|---|
| | | E-Tag | IGFaR | IR | IGFR/IR | IR/IGFR |
| 20E2Bα-3-D7-IR | TMGTQGFYRWFQNVVKEHLSG | 35.4 | 26.9 | 31.3 | 0.9 | 1.2 |
| 20E2Bα-3-A12-IR | ITHNRGFYSWFLDVVQGGAGA | 31.7 | 22.0 | 23.3 | 0.9 | 1.1 |
| 20E2Bα-3-D10-IR | VRRDAGFYQWFADILTQLDFE | 32.7 | 27.3 | 29.1 | 0.9 | 1.1 |
| 20E2Bα-4-G7-IR | MQLQDEFYNWFRGIMLNDGQD | 34.2 | 29.0 | 30.7 | 0.9 | 1.1 |
| 20E2Bα-4-F5-IR | GIRSSGFYQWFDRVLAGVGDG | 33.8 | 32.1 | 34.0 | 0.9 | 1.1 |
| 20E2Bα-3-C9-IR | ANLNSQFYSWFASVTGEASPS | 39.4 | 33.2 | 35.5 | 0.9 | 1.1 |
| 20E2Bα-3-A4-IR | QSPRASFYGWFDDVLRAAGVV | 38.2 | 31.6 | 35.9 | 0.9 | 1.1 |
| 20E2Bα-4-E12-IR | MQRNQGFYSWFDDLVSSTVGV | 36.0 | 30.8 | 29.7 | 1.0 | 1.1 |
| 20E2Bα-4-E11-IR | ASGFDPFYAWFLEQLRVANGS | 35.1 | 31.2 | 30.7 | 1.0 | 1.0 |
| 20E2Bα-4-E8-IR | SGTPYGFYRWFQSALASATSG | 36.1 | 30.5 | 30.7 | 1.0 | 1.0 |
| 20E2Bα-4-H10-IR | QGVEGGFYEWFDRAMGDVRPW | 38.9 | 30.6 | 30.7 | 1.0 | 1.0 |
| 20E2Bα-4-F6-IR | DNMSGGFYRWFAQVVADSGGD | 34.9 | 33.2 | 32.0 | 1.0 | 1.0 |
| 20E2Bα-4-G4-IR | RGTDDTFYGWFDQLLQGWCDD | 34.1 | 33.7 | 32.2 | 1.0 | 1.0 |
| 20E2Bα-4-F8-IR | TVDHTQFYDWFSRVLGESGSA | 37.7 | 32.0 | 32.7 | 1.0 | 1.0 |
| 20E2Bα-4-G5-IR | GRQDREFYYWFELQAGGMDGD | 34.9 | 33.9 | 33.4 | 1.0 | 1.0 |
| 20E2Bα-3-B10-IR | RLLLGGFYEWFDQVLKETKEV | 38.2 | 34.9 | 33.6 | 1.0 | 1.0 |
| 20E2Bα-3-C7-IR | GVLSTGFYEWFALQLHGLAAG | 37.6 | 34.2 | 34.8 | 1.0 | 1.0 |
| 20E2Bα-3-C5-IR | PAVGQSFYGWFEAVLRGSKAG | 40.4 | 36.0 | 35.6 | 1.0 | 1.0 |
| JE2Bα-3-B9-IR | SNGISGFYEWFAAQVQTSDFQ | 39.6 | 35.8 | 37.1 | 1.0 | 1.0 |
| A6L-4-F11-IR | LLGLSQAAYANFYDWFVSQLA | 33.1 | 4.6 | 4.6 | 1.0 | 1.0 |
| 20E2Bα-3-C2-IR | VPNSWMFYNWFAEQIEGSEGE | 44.1 | 40.0 | 38.1 | 1.0 | 1.0 |
| 20E2Bα-3-B2-IR | ARRADGFYDWFREQVSGSAVQ | 43.1 | 40.1 | 39.0 | 1.0 | 1.0 |
| 20E2Bα-4-G2-IR | GVVEGTFYEWFDRLLGGVQGD | 34.1 | 33.6 | 29.8 | 1.1 | 0.9 |
| 20E2Bα-4-H6-IR | SHLTDPFYQWFVDQLRAGVRG | 39.4 | 36.0 | 31.9 | 1.1 | 0.9 |

FIG. 10-2

| Clone Design | Sequence $X_n$-FyxWF-$X_m$ | Ratios over Background | | | Comparisons | |
|---|---|---|---|---|---|---|
| | | E-Tag | IGFsR | IR | IGFR/IR | IR/IGFR |
| 20E2Bα-4-H5-IR | RSNDDAFYRWFSNILQVDGGG | 38.7 | 35.1 | 32.3 | 1.1 | 0.9 |
| 20E2Bα-4-G3-IR | DSDGAQFYIWFEDQLRSAGWD | 35.5 | 36.1 | 32.7 | 1.1 | 0.9 |
| 20E2Bα-4-H4-IR | PGLHRAFYQWFAEAVRSANKE | 38.8 | 37.9 | 35.0 | 1.1 | 0.9 |
| 20E2Bα-3-C1-IR | SLGQGGFYDWFASQVGGADI | 43.7 | 42.1 | 39.0 | 1.1 | 0.9 |
| 20E2Bα-4-E6-IR | CGQTQSFYQWFCEVMRVESGD | 38.0 | 34.3 | 29.7 | 1.2 | 0.8 |
| H5-3-D5-IR | IVVPGDTQGVNFYDWFVKQLQ | 43.8 | 21.8 | 18.2 | 1.2 | 0.8 |
| JBA5-3-D9-IR | RDVSMGSASTNFYDWFVQQLG | 38.3 | 29.8 | 25.3 | 1.2 | 0.8 |
| 20E2Bβ-4-G6-IR | SQAGSAFYAWFDQVLRTVHSA | 22.4 | 6.2 | 1.9 | 3.3 | 0.3 |
| 20E2Bβ-4-H10-IR | SNGISGFYEWFAAQVQTSDFQ | 23.5 | 32.2 | 9.7 | 3.3 | 0.3 |
| rB6-4-G8-IR | RRDRGGLDVFFYQWFMD | -- | -- | -- | -- | -- |

FIG. 1O-3

| Clone Design | Sequence | Ratios over Background | | | Comparisons | |
|---|---|---|---|---|---|---|
| | | E-Tag | IGFsR | IR | IGFR/IR | IR/IGFR |
| F815-4-H9-IR | HLCVLEELFWGASLFGYCSG | -- | -- | -- | -- | -- |
| F815-3-B1-IR | PLCVLEELFWSTPLFGQCSY | 34.9 | 0.9 | 37.6 | <0.1 | 40.8 |
| F815-3-D1-IR | HLCVLEELFWGASLFAQCVG | 31.7 | 0.9 | 35.8 | <0.1 | 39.3 |
| F815-3-D4-IR | DLCVLEELFWGASRFGQCSG | 30.4 | 0.9 | 33.5 | <0.1 | 38.9 |
| F815-3-C5-IR | HLCVLEELFWGASLFGQCAG | 31.5 | 0.9 | 33.6 | <0.1 | 38.8 |
| F815-4-H3-IR | HLCVVEELFWGASLFGQCSG | 31.1 | 0.8 | 31.2 | <0.1 | 38.5 |
| F815-3-A5-IR | NLCDLEVLFWGASLFRQCSG | 31.7 | 1.0 | 37.2 | <0.1 | 38.4 |
| F815-3-D7-IR | PLCVLEEQFWGASLFGQCSG | 37.4 | 1.1 | 40.9 | <0.1 | 38.3 |
| F815-3-A1-IR | QLCVLEELFWGASEFGQCSG | 33.6 | 0.9 | 34.3 | <0.1 | 38.3 |
| F815-4-H4-IR | HLCELEELFWGASLFGQCSG | 29.8 | 0.9 | 34.8 | <0.1 | 38.0 |
| F815-3-A3-IR | PLCVLEELFWGESLFGQCSG | 31.1 | 0.9 | 32.7 | <0.1 | 38.0 |
| F815-3-B3-IR | HLCVLEELFWGASRFGQCSG | 32.8 | 1.0 | 39.1 | <0.1 | 37.9 |
| F815-3-A4-IR | KLCVLEELFWGASLFGQCSG | 33.7 | 1.0 | 37.5 | <0.1 | 37.5 |
| F815-3-D2-IR | YLCVLEELSWGASLFGQCSG | 32.5 | 1.0 | 36.9 | <0.1 | 37.5 |
| F815-3-C4-IR | HLCVLEELLNGASLFAQCSG | 31.9 | 0.9 | 34.1 | <0.1 | 37.4 |
| F815-3-B4-IR | QLCVLEEQLFWGESLFGQCSG | 31.6 | 0.8 | 31.8 | <0.1 | 37.4 |
| F815-3-C1-IR | HLCVLEELFWGGNLFSQCSG | 33.8 | 0.9 | 36.7 | <0.1 | 37.3 |
| F815-4-G9-IR | HLCVLEELFWGASLYGQCSG | 29.0 | 0.9 | 35.0 | <0.1 | 37.3 |
| F815-4-F4-IR | SLCALEEQFWGASLFDGCAG | 36.5 | 1.0 | 38.9 | <0.1 | 37.1 |
| F815-4-G6-IR | HLCVLEEQFWGASLFDGCAG | 34.9 | 1.0 | 36.4 | <0.1 | 37.0 |
| F815-3-A8-IR | QLCVLEELFWGASLFGQCSG | 34.7 | 1.1 | 39.3 | <0.1 | 36.9 |
| F815-4-G5-IR | PLCVLEELFWGAALFGQCSG | 26.5 | 1.0 | 35.1 | <0.1 | 36.8 |
| F815-3-B5-IR | HLCVLEELFWGASLFGQCTG | 33.2 | 0.9 | 34.1 | <0.1 | 36.8 |
| F815-4-F4-IR | PLCVLEELFWGGSLFGQCSG | 28.6 | 0.8 | 30.0 | <0.1 | 36.7 |
| F815-3-A2-IR | QLCVLEELVWGASLFGQCSG | 32.5 | 1.0 | 36.6 | <0.1 | 36.6 |
| F815-3-B6-IR | HLCVVEELIWGASLFGQCSR | 31.6 | 0.9 | 32.9 | <0.1 | 36.5 |
| F815-4-H7-IR | DLCVLEELFWGASLFGQCAG | 33.7 | 1.0 | 37.6 | <0.1 | 36.4 |
| F815-4-H8-IR | QLCVLEERFWGASLFGQCSG | 35.8 | 1.0 | 37.0 | <0.1 | 36.4 |
| F815-4-G7-IR | NLCVLEELFWGAALFGQCSG | 33.7 | 1.0 | 35.8 | <0.1 | 36.3 |

FIG. 2B-1

| Clone Design | Sequence | Ratios over Background | | | Comparisons | |
|---|---|---|---|---|---|---|
| | | E-Tag | IGFaR | IR | IGFR/IR | IR/IGFR |
| | HLCVLEELFWGASLFGYCSG | -- | -- | -- | -- | -- |
| F815-3-A6-IR | QLCVLEELFWGSSLFGQCSG | 34.6 | 1.1 | 39.0 | <0.1 | 36.2 |
| F815-3-D3-IR | DLCVVEELFWGKSLFGQCSG | 33.8 | 1.0 | 36.2 | <0.1 | 36.2 |
| F815-3-B12-IR | DLCVLEELFWGSSLFGQCSG | 33.2 | 1.0 | 35.7 | <0.1 | 36.2 |
| F815-4-G10-IR | YLCVLEEQFWGASLFRQCFG | 35.4 | 1.0 | 37.2 | <0.1 | 36.1 |
| F815-4-E3-IR | HLCVLEELLWGSSLFGQCSG | 32.4 | 1.0 | 35.0 | <0.1 | 36.1 |
| F815-4-E6-IR | PLCGLEELFWGASLFGQCSD | 33.2 | 1.0 | 34.5 | <0.1 | 36.1 |
| F815-4-F1-IR | HLCVLEELFWGSSLFAQCSG | 29.4 | 0.9 | 32.5 | <0.1 | 36.0 |
| F815-4-G8-IR | PLCAIEELFWGAALFGQCSG | 36.8 | 1.1 | 38.2 | <0.1 | 36.0 |
| F815-4-H12-IR | HLCVLEEQFWGASLFGDCSG | 30.5 | 0.9 | 31.9 | <0.1 | 35.9 |
| F815-4-G3-IR | PLCVLEELFWGAPLFGQCSD | 31.4 | 1.0 | 35.7 | <0.1 | 35.9 |
| F815-3-C2-IR | DLCGLEELFWGAALFGQCTS | 32.3 | 1.0 | 36.1 | <0.1 | 35.7 |
| F815-4-E10-IR | QLCVLEKQLWGASLFWQCSG | 35.4 | 1.0 | 36.5 | <0.1 | 35.6 |
| F815-3-A12-IR | HLCVLEELFWGASLYGQCPG | 32.1 | 1.0 | 36.3 | <0.1 | 35.4 |
| F815-3-B8-IR | HLCVLEELFWGASLFDQCSG | 33.6 | 1.0 | 35.8 | <0.1 | 35.3 |
| F815-3-B2-IR | HLCVLEELLWGASLFGQCGG | 31.0 | 1.0 | 35.3 | <0.1 | 35.3 |
| F815-3-C3-IR | PLCVLEELFWGVSLFGQCGG | 30.1 | 1.0 | 35.3 | <0.1 | 35.3 |
| F815-3-A7-IR | HLCVLEELFWGASQWGQCSG | 33.1 | 1.0 | 35.8 | <0.1 | 35.2 |
| F815-4-F9-IR | HLCVLEEQFWGGALFGQCSG | 33.4 | 1.0 | 35.7 | <0.1 | 35.2 |
| F815-3-B7-IR | RLCVLEELFWGVSLFAQCSG | 32.0 | 1.0 | 33.5 | <0.1 | 35.0 |
| F815-4-E4-IR | QLCVLEELFWGAALFGQCFG | 28.0 | 1.0 | 33.4 | <0.1 | 35.0 |
| F815-4-E12-IR | HLCVLEELFWGASQFGQCSG | 28.0 | 0.9 | 30.2 | <0.1 | 34.8 |
| 815-4-F8-IR | YLCVLEELYWGASLFGQCSG | 33.8 | 1.0 | 35.2 | <0.1 | 34.7 |
| F815-3-C7-IR | HLCVLEERFWGVSLFGQCSG | 33.9 | 1.0 | 34.7 | <0.1 | 34.7 |
| F815-4-F10-IR | PLCVLEELFWGASRFGQCSG | 32.7 | 1.1 | 34.2 | <0.1 | 34.7 |
| F815-3-D11-IR | HLCVLEDLFWGASLFDQCSG | 35.4 | 1.1 | 37.3 | <0.1 | 34.6 |
| F815-4-E7-IR | HLCDLEVLFWGASLFGQCSG | 30.3 | 0.9 | 32.2 | <0.1 | 34.6 |
| F815-3-A10-IR | QLCILEEQFWGTSLFGYCSG | 34.0 | 1.1 | 36.4 | <0.1 | 34.3 |
| F815-3-B11-IR | ALCVLEELFWGESLFGQCSG | 33.7 | 1.1 | 36.3 | <0.1 | 34.2 |

FIG. 2B-2

| Clone Design | Sequence | E-Tag | IGFsR | IR | IGFR/IR | IR/IGFR |
|---|---|---|---|---|---|---|
| F815-4-F11-IR | HLCVLEELFWGASLFGICSG | -- | -- | -- | -- | -- |
| F815-4-F11-IR | RLCVLEERFWGAALFGQCSG | 31.8 | 1.0 | 33.7 | <0.1 | 34.2 |
| F815-3-A9-IR | PLCVLEELFWGASLFGQCSG | 31.9 | 1.0 | 35.5 | <0.1 | 34.1 |
| F815-4-G11-IR | SLCVLEELFWGGSRFGQCSG | 32.3 | 1.0 | 34.4 | <0.1 | 33.9 |
| F815-3-D8-IR | HLCLLEEQFWGASLFGYCFE | 32.3 | 1.0 | 33.3 | <0.1 | 33.7 |
| F815-4-G4-IR | HLCVLEEQFWGASLFGQCSG | 23.8 | 1.0 | 32.2 | <0.1 | 33.7 |
| F815-3-C8-IR | DLCLLEELLWGASRFGQCSG | 33.9 | 1.0 | 35.1 | <0.1 | 33.6 |
| F815-4-G12-IR | YLCVLEERFWGASLFGQCSG | 31.7 | 1.0 | 33.5 | <0.1 | 33.5 |
| F815-3-D12-IR | HLCVLEEQFWGASLFGSCSG | 33.3 | 1.0 | 34.8 | <0.1 | 33.4 |
| F815-4-F7-IR | QLCVLEEQLWGASLFGQCSG | 33.3 | 1.0 | 34.3 | <0.1 | 33.4 |
| F815-4-F2-IR | HLCVLEELF*GESLFGYCSG | 26.1 | 1.0 | 33.8 | <0.1 | 33.3 |
| F815-3-B9-IR | HLCVLEELFWGASLFGQCSG | 33.6 | 1.1 | 35.7 | <0.1 | 33.2 |
| F815-4-H2-IR | PLCVLEELFWGASHFGQCSG | 36.1 | 1.2 | 38.4 | <0.1 | 33.0 |
| F815-4-E11-IR | HLCVLEELVWGASLFGQCAG | 33.2 | 1.1 | 35.4 | <0.1 | 33.0 |
| F815-4-G1-IR | QLCVLEELIWGASLFGQCAG | 27.9 | 1.0 | 31.5 | <0.1 | 33.0 |
| F815-3-A11-IR | HLCVLEELVWGESLFGQCSG | 37.7 | 1.2 | 40.1 | <0.1 | 32.8 |
| F815-4-F6-IR | RLCVLEELYWGASLFGQCSG | 32.3 | 1.1 | 34.6 | <0.1 | 32.7 |
| F815-3-D9-IR | RLCILEELFWGASLFGQCSG | 31.4 | 1.1 | 32.5 | <0.1 | 32.6 |
| F815-3-C11-IR | HLCLLEELFWGATLFDQCSG | 33.4 | 1.1 | 35.7 | <0.1 | 32.5 |
| F815-3-G2-IR | HLCFLEELFWGASMFGQCSG | 30.2 | 1.0 | 34.3 | <0.1 | 31.9 |
| F815-3-C9-IR | HLCIVEELFWAAPLFGQCSG | 29.7 | 0.9 | 31.4 | <0.1 | 31.4 |
| F815-4-H10-IR | HLCVLEELWWGASLFAQCSA | 31.9 | 1.0 | 27.6 | <0.1 | 31.0 |
| F815-4-F3-IR | NLCALEELFWGASQFRYCPG | 19.4 | 0.9 | 28.0 | <0.1 | 29.4 |
| F815-4-F5-IR | RLCVLEELFWGASLFGQCSG | 12.3 | 1.0 | 24.8 | <0.1 | 28.9 |
| F815-4-H1-IR | PLCVLEELFWGASLFGQCPG | 6.9 | 1.0 | 15.8 | 0.1 | 26.8 |
| F815-4-E5-IR | NLCVLEELFWGASLFGQCSG | 3.5 | 1.0 | 13.6 | 0.1 | 16.5 |
| F815-4-H5-IR | QLCVLG#RFMGGSLCGYCSD | 5.5 | 1.0 | 13.1 | 0.1 | 14.0 |
| F815-3-C10-IR |  | 3.5 | 1.1 | 5.2 | 0.2 | 4.5 |

FIG. 2B-3

| Clone | Sequence | Ratios over Background | | | Comparisons | |
|---|---|---|---|---|---|---|
| Parental/Design | | E-Tag | IGFaR | IR | IGFR/IR | IR/IGFR |
| F815-4-F11-IGFR | HLCVLEELFWGASLFGYCSG | 39.1 | 1.8 | 27.7 | 0.1 | 15.4 |
| F815-4-F11-IGFR | PLCFLQELFGGASLGGYCSG | 33.4 | 12.3 | 1.0 | 12.3 | 0.1 |
| F815-4-E12-IGFR | FMCGLQELVGGAALLGHCSG | 33.7 | 15.1 | 1.7 | 8.9 | 0.1 |
| F815-4-H10-IGFR | PLCFLQELFGGGSLSGYCSG | 30.1 | 8.5 | 1.0 | 8.5 | 0.1 |
| F815-4-B7-IGFR | FLCGLEELAWGVSRSGYCFG | 35.2 | 23.9 | 4.8 | 5.0 | 0.2 |
| F815-3-B5-IGFR | PLCFLAELFSGSALGGDCSR | 33.9 | 4.8 | 1.0 | 4.8 | 0.2 |
| F815-4-D12-IGFR | PLCVLQELFGGGSLGGYCSG | 33.6 | 7.0 | 1.8 | 3.9 | 0.3 |
| F815-4-C11-IGFR | QLCVLEALFWGACLFGYCAG | 13.9 | 4.6 | 1.8 | 2.6 | 0.4 |
| F815-4-C7-IGFR | FLCGLQELSGVASLFGQCSG | 16.8 | 2.0 | 1.0 | 2.0 | 0.5 |
| F815-4-E7-IGFR | RVCVLEQLVWGASLFGA*SG | 26.9 | 3.8 | 1.9 | 2.0 | 0.5 |
| F815-4-G7-IGFR | FYCGLEELSWGAALFGYCSG | 30.4 | 9.0 | 5.0 | 1.8 | 0.6 |
| F815-4-A10-IGFR | FLCGLEELSQGAVLFGHCYG | 30.8 | 3.7 | 2.2 | 1.7 | 0.6 |
| F815-3-B3-IGFR | HLCVLVGLFWDASLFGQCSG | 7.6 | 1.0 | 2.0 | 0.5 | 2.0 |
| F815-3-G1-IGFR | QRCIRAALFWCATLLGGCAG | 20.5 | 1.0 | 2.0 | 0.5 | 2.0 |
| F815-4-G12-IGFR | HQCIPDGMSQGAALRGNCSD | 7.6 | 1.0 | 2.5 | 0.4 | 2.5 |
| F815-3-H1-IGFR | HLCVLEDELWGVSLFGYCSS | 18.4 | 1.0 | 6.8 | 0.1 | 6.8 |

FIG. 2C

| Clone | Sequence | E-Tag | IGFaR | IR | IGFR/IR | IR/IGFR |
|---|---|---|---|---|---|---|
| Parental/Design | HLCVLEELFWGASLFGYCSG | | | | | |
| F820-4-B5-IR | HLCMLEEQFWGASLFSRCSG | 39.1 | 1.8 | 27.7 | 0.1 | 15.4 |
| F820-4-A2-IR | TCAFWKNGSGVRRCSVTAVV | 28.1 | 0.9 | 17.9 | <0.1 | 21.1 |
| F820-4-E2-IR | PLCGLKN.SGVRLCSSPALV | 34.0 | 1.6 | 22.7 | 0.1 | 13.9 |
| F820-4-D10-IR | PLCLQEELFWGASLFGYCSG | 21.3 | 0.7 | 9.0 | 0.1 | 13.4 |
| F820-4-H7-IR | PLCDLEELFWGASLFGDCPG | 34.1 | 1.0 | 12.1 | 0.1 | 12.1 |
| F820-4-G6-IR | DLCVLEELFWDGSLFASCSG | 14.2 | 0.6 | 6.5 | 0.1 | 11.6 |
| F820-4-C2-IR | PLCVLEEQLNGTALFGSCTG | 14.0 | 0.5 | 6.1 | 0.1 | 11.5 |
| F820-4-B4-IR | PLCLVEELLMGASLFSQCTG | 38.1 | 1.2 | 11.8 | 0.1 | 9.9 |
| F820-4-C7-IR | PLCDLEELYWGAALFGSCSG | 15.1 | 0.7 | 6.4 | 0.1 | 8.7 |
| F820-4-F10-IR | GLCFLEEQFWGTSLFRDCPG | 46.3 | 2.7 | 22.2 | 0.1 | 8.2 |
| F820-4-G5-IR | PLCVVEELFWGASLYGQCSG | 14.5 | 0.6 | 4.7 | 0.1 | 8.0 |
| F820-4-F2-IR | RLCVLEELFWGASRFRGCSG | 8.8 | 0.6 | 4.4 | 0.1 | 7.5 |
| F820-4-H8-IR | PLCVLEELHMGAALFGYCSG | 11.7 | 0.6 | 4.2 | 0.1 | 7.4 |
| F820-4-D7-IR | NLCVVEELFWGASLFPNCSG | 16.0 | 0.6 | 4.7 | 0.1 | 7.3 |
| F820-4-B2-IR | QLCVLEELFWGASMFEDCSG | 14.5 | 0.8 | 5.9 | 0.1 | 7.1 |
| F820-4-C3-IR | HLCVLEEQFWGASLFGQCSG | 5.0 | 0.4 | 2.4 | 0.2 | 6.9 |
| F820-4-H4-IR | PLCVLEEIYWGAAALFGDCYG | 37.5 | 1.1 | 7.5 | 0.2 | 6.6 |
| F820-4-B10-IR | PLCVLEELFWGLSLDKNCS | 21.2 | 1.1 | 6.4 | 0.2 | 5.9 |
| F820-4-A5-IR | QLCVLEELFWGASLFSGCSG | 7.5 | 0.7 | 3.7 | 0.2 | 5.6 |
| F820-4-F6-IR | PLCDLEALFWGESLFGGCSG | 5.3 | 0.8 | 4.4 | 0.2 | 5.2 |
| F820-4-F1-IR | HLCVLEEMFWGTSHFDGCSG | 5.7 | 0.6 | 3.0 | 0.2 | 4.9 |
| F820-4-A3-IR | DLCVLEELFWGAPLFGLCSG | 9.1 | 1.0 | 4.7 | 0.2 | 4.7 |
| F820-4-D1-IR | DLCVLEELFWGVALYGGCSG | 5.9 | 0.8 | 3.5 | 0.2 | 4.5 |
| F820-4-F5-IR | QLCVLEELYWGASLFGHCSG | 25.7 | 2.3 | 10.5 | 0.2 | 4.5 |
| F820-4-F12-IR | HLCVLEDRFWGASLFGPCSG | 3.7 | 0.6 | 2.7 | 0.2 | 4.2 |
| F820-4-A11-IR | HLCGMEEMFWGVALFRNCSG | 11.3 | 0.6 | 2.2 | 0.3 | 3.5 |
| F820-4-E8-IR | PLCVLEQLYWGESLFVYCSG | 7.6 | 0.8 | 2.7 | 0.3 | 3.5 |
| F820-4-H3-IR | HLCLLEELFWGEALWGYCSG | 8.0 | 1.2 | 4.3 | 0.3 | 3.5 |
| | | 17.5 | 2.6 | 9.0 | 0.3 | 3.4 |

FIG. 2D-1

| Clone | Sequence | Ratios over Background | | | Comparisons | |
|---|---|---|---|---|---|---|
| Parental/Design | | E-Tag | IGFaR | IR | IGFR/IR | IR/IGFR |
| F820-4-A8-IR | HLCVLEELFWGASLFGYCSG | 6.4 | 0.7 | 2.4 | 0.3 | 3.4 |
| F820-4-G1-IR | QLCVMEELFWGASRFGQCSG | 3.9 | 0.6 | 1.9 | 0.3 | 3.4 |
| F820-4-F3-IR | HLCVLEELFWGASMFGQCSG | 9.8 | 1.3 | 3.6 | 0.4 | 2.9 |
| F820-4-D6-IR | QLCVLEEMFWGGSRFVQCSA | 5.4 | 1.2 | 3.2 | 0.4 | 2.6 |
| F820-4-A1-IR | PLCILEELFWGEALFDQCGA | 25.5 | 2.4 | 6.1 | 0.4 | 2.5 |
| F820-4-H2-IR | YLCVQEELFWGASLFGYCSV | 15.9 | 1.6 | 4.1 | 0.4 | 2.5 |
| F820-4-F4-IR | HLCALEEAFFGPSLFNSCQG | 6.8 | 1.9 | 4.7 | 0.4 | 2.5 |
| F820-4-B6-IR | HLCVLEERFWGASLFGQCSG | 4.1 | 0.8 | 1.9 | 0.4 | 2.4 |
| F820-4-B11-IR | QLCDLEELFWGASLFGYCPG | 22.2 | 3.1 | 7.0 | 0.4 | 2.3 |
| F820-4-H6-IR | HLCVLEERFWGASIWGSCSG | 4.1 | 1.1 | 2.4 | 0.5 | 2.2 |
| F820-4-H9-IR | QLCVLEELFWGGSLWGQCSR | 3.1 | 0.9 | 1.9 | 0.5 | 2.1 |
| F820-4-D3-IR | PLCDLEERFWGAAQFGQCSG | 4.6 | 1.3 | 2.5 | 0.5 | 1.9 |
| F820-4-C1-IR | QLCDLEERFWGVSLFGLCSG | 13.0 | 1.1 | 2.1 | 0.5 | 1.9 |
| F820-4-D12-IR | QLCVLEEVFWGASLFGLCTG | 10.4 | 1.2 | 2.0 | 0.6 | 1.7 |
| F820-4-B8-IR | QL.DLNTWSGLCLCSVTVRV | 7.2 | 2.2 | 3.4 | 0.6 | 1.5 |
| F820-4-C6-IR | DLCVLEESLWGKALFGYCSD | 13.9 | 2.5 | 2.8 | 0.9 | 1.1 |
| F820-4-C10-IR | HLCVLEEVFWGSSMFGDCSG | 5.3 | 2.6 | 2.9 | 0.9 | 1.1 |
| F820-4-D4-IR | HLCDLEELFWGASLFGDCQG | 3.5 | 2.3 | 2.1 | 1.1 | 0.9 |
| F820-4-E1-IR | QLCVLDALMWGGCRLGHQCG | 1.6 | 1.6 | 1.5 | 1.1 | 0.9 |
| F820-4-B3-IR | QLCVLEEKFWGTSLFGDCMG | 15.9 | 0.6 | 5.0 | 1.2 | 0.8 |
| F820-4-D2-IR | HLCVLEEVFWGAAQFGSCSG | 7.8 | 3.2 | 2.5 | 1.3 | 0.8 |
| F820-4-C5-IR | QLCVLEELFWGPSMFGYCSG | 21.5 | 4.0 | 2.3 | 1.8 | 0.6 |
| | HLCDLEELFWGASGFAQCYG | | | | | |

FIG. 2D-2

| Clone Design | Sequence | Ratios over Background | | | Comparisons | |
|---|---|---|---|---|---|---|
| | | E-Tag | IGFsR | IR | IGFR/IR | IR/IGFR |
| | HLCVLEELFWGASLFGYCSG | -- | -- | -- | -- | -- |
| A6L-3-C4-IR | DLCVLEERFWGASLFGYCSG | 36.9 | 1.0 | 40.5 | <0.1 | 42.5 |
| A6L-3-D7-IR | QLCVLEELHWGASLFGYCSG | 38.6 | 1.0 | 40.1 | <0.1 | 40.7 |
| A6L-3-A1-IR | PLCVLEEQFWGASLFGQCSG | 39.6 | 1.1 | 44.8 | <0.1 | 40.6 |
| A6L-3-C1-IR | YLCDLEERFWGASLFGQCSS | 37.3 | 1.0 | 40.3 | <0.1 | 40.3 |
| A6L-3-D5-IR | HLCILEERFWGSSQFGFCSG | 42.9 | 1.1 | 44.4 | <0.1 | 40.2 |
| A6L-3-A4-IR | HLCVLEELFWGASQFGQCSG | 26.7 | 1.1 | 42.2 | <0.1 | 40.2 |
| A6L-3-D3-IR | HLCYLEERFWGASLFGQCSG | 34.6 | 0.9 | 36.9 | <0.1 | 39.8 |
| A6L-3-B1-IR | HLCVMEELFWGTSLFGQCTG | 33.9 | 1.0 | 38.7 | <0.1 | 39.3 |
| A6L-3-B5-IR | HLCVLEERFWGASLFGQCSG | 35.3 | 1.1 | 42.4 | <0.1 | 38.6 |
| A6L-3-B2-IR | HLCVLEERFWGASLFSQCSG | 38.1 | 1.1 | 42.7 | <0.1 | 37.7 |
| B6H-4-G12-IR | HLCVLEELFWGAASFGQCSG | 31.6 | 1.1 | 39.6 | <0.1 | 36.7 |
| B6C-4-H10-IR | QLCVLEELFWGASLFGQCSG | 38.5 | 1.1 | 41.1 | <0.1 | 36.5 |
| B6H-4-G8-IR | HLCVLEEMFWGASLFGQCSG | 31.7 | 1.0 | 39.7 | <0.1 | 36.2 |
| A6L-3-D6-IR | HLCDLEELFWGASLFSQCSR | 35.5 | 1.1 | 37.2 | <0.1 | 36.1 |
| B6C-4-F1-IR | QLCVLEELFWGASQFGYCSG | 32.9 | 1.1 | 38.7 | <0.1 | 35.8 |
| B6H-4-H3-IR | QLCALEEQFWGASLFSQCSG | 37.4 | 1.2 | 40.5 | <0.1 | 34.8 |
| B6H-4-E8-IR | QLCVLEELFSGYCSG | 30.2 | 1.0 | 35.7 | <0.1 | 34.3 |
| B6C-4-G1-IR | HLCVLEEWFWGDSLFGQCSR | 34.9 | 1.2 | 40.2 | <0.1 | 33.7 |
| B6H-4-E9-IR | HLCVLEERFWGASLFGQCSG | 34.4 | 1.2 | 38.8 | <0.1 | 33.2 |
| B6C-4-F5-IR | QLCELEEVFWGASLFDYCSG | 34.7 | 1.2 | 39.6 | <0.1 | 32.8 |
| B6C-4-F11-IR | HLCVLEELFWGASRFGQCSG | 34.0 | 1.2 | 37.2 | <0.1 | 31.7 |
| 5C-4-E6-IR | HLCVLEELFWGASLFGQCSA | 32.3 | 1.2 | 37.4 | <0.1 | 30.6 |
| B6C-4-E12-IR | HLCVLEELIWGASRFGQCSG | 30.9 | 1.1 | 33.3 | <0.1 | 30.2 |
| B6C-4-G10-IR | HLCVLEELFWGGSLFIQCSG | 33.0 | 1.3 | 40.3 | <0.1 | 30.1 |
| B6C-4-F8-IR | QLCVLEEQFWGASLFGNCSG | 36.4 | 1.4 | 39.8 | <0.1 | 29.3 |
| 20C-3-B5-IR | HLCVLEERFWGAALFGQCSG | 26.6 | 1.1 | 32.5 | <0.1 | 29.2 |
| B6C-4-G3-IR | HLCILEEMFWGASLFGQCGG | 34.0 | 1.4 | 38.8 | <0.1 | 28.3 |
| 20C-3-B7-IR | PLCVLEELVWGASLFVQCSG | 29.5 | 1.2 | 32.9 | <0.1 | 28.3 |

FIG. 2E-1

| Clone Design | Sequence | Ratios over Background | | | Comparisons | |
|---|---|---|---|---|---|---|
| | | E-Tag | IGFsR | IR | IGFR/IR | IR/IGFR |
| | HLCVLEELFWGASLFGYCSG | -- | -- | -- | -- | -- |
| 20C-3-B4-IR | NLCVLEELFWGESLFGQCSG | 28.9 | 1.1 | 31.1 | <0.1 | 28.0 |
| 20C-3-C11-IR | HLCVLEEQFWGGSLFGYCSR | 30.2 | 1.1 | 31.0 | <0.1 | 27.7 |
| B6C-4-G2-IR | HLCFLEEVFWGAALFAQCSG | 29.4 | 1.3 | 35.3 | <0.1 | 27.5 |
| 20C-3-B8-IR | HLCDLEVLFWGSALFGYCSG | 28.5 | 1.1 | 31.2 | <0.1 | 27.4 |
| 20C-3-C10-IR | HLCVMEELFWGASLFGQCSG | 32.1 | 1.2 | 33.6 | <0.1 | 27.1 |
| 20C-3-B6-IR | HLCVLEERFWGASLFWQCSG | 29.7 | 1.2 | 31.9 | <0.1 | 26.7 |
| A6L-3-A3-IR | HLCVLEEQYWGESLFGYCSG | 14.4 | 1.1 | 28.3 | <0.1 | 26.5 |
| A6L-3-B3-IR | PLCVLEEQFWGASLFAYCSS | 38.7 | 1.7 | 43.4 | <0.1 | 26.3 |
| 20C-3-A5-IR | QLCVLEELFWGESLFAQCLG | 22.9 | 1.1 | 27.6 | <0.1 | 26.0 |
| 20C-3-B11-IR | HLCVLEELFWGQSLFGHCSD | 30.0 | 1.3 | 32.7 | <0.1 | 25.8 |
| 20C-3-B3-IR | HLCVLEELVWGASLFGFCSG | 29.3 | 1.2 | 31.2 | <0.1 | 25.7 |
| 20C-3-C12-IR | LLCVLEEQFWGASLFGQCSG | 29.6 | 1.3 | 31.8 | <0.1 | 24.8 |
| 20C-3-C3-IR | RLCVLEELFWGESLFGQCSG | 30.1 | 1.2 | 30.1 | <0.1 | 24.3 |
| 20C-3-C2-IR | HLCVLEEMFWGASLFGNCSG | 29.9 | 1.3 | 29.8 | <0.1 | 23.8 |
| 20C-3-A11-IR | ELCFLEELFWGASLFGQCSG | 25.9 | 1.2 | 27.4 | <0.1 | 23.0 |
| 20C-3-A4-IR | HLCVLEELFWGASLYGQCSS | 27.2 | 1.2 | 27.5 | <0.1 | 22.9 |
| 20C-3-A6-IR | HLCVLEELFWGASLFAQCPG | 26.1 | 1.2 | 27.5 | <0.1 | 22.8 |
| B6C-4-E4-IR | NLCVLEELFWGASEFGQCSG | 34.5 | 1.7 | 39.1 | <0.1 | 22.7 |
| 20C-3-A9-IR | DLCVLEEQLWGASLFRYCSG | 29.7 | 1.3 | 29.3 | <0.1 | 22.7 |
| B6C-3-C5-IR | HLCVLEELFWGVALFGNCSG | 33.5 | 1.7 | 37.7 | <0.1 | 22.5 |
| 20C-3-B1-IR | HLCVLEVQIWGASLFGQCSG | 30.2 | 1.2 | 26.7 | <0.1 | 22.0 |
| 20C-3-A10-IR | HLCVLEERFWGGALFGQCTA | 29.0 | 1.3 | 28.5 | <0.1 | 21.5 |
| 20C-4-F1-IR | HLCDLEELFWGASLFGQCSG | 29.1 | 1.4 | 29.5 | <0.1 | 20.7 |
| 20C-4-E1-IR | QLCVLEELFWGTSLFAGCSG | 28.3 | 1.4 | 29.7 | <0.1 | 20.6 |
| 20C-3-B12-IR | HLCVLEELFWGASLFGYCSA | 27.0 | 1.3 | 25.8 | <0.1 | 20.2 |
| 20C-3-A8-IR | QLCGLEELFWGASQFGQCSG | 21.1 | 1.1 | 21.2 | <0.1 | 20.0 |
| 20C-3-A7-IR | FLCVLEELYWGASLFGQCSG | 21.9 | 1.3 | 23.0 | 0.1 | 18.3 |
| B6C-4-E10-IR | HLCVLEEQFWGASLFGYCSG | 35.2 | 2.2 | 38.0 | 0.1 | 17.5 |

FIG. 2E-2

| Clone | Sequence | Ratios over Background | | | Comparisons | |
|---|---|---|---|---|---|---|
| Design | | E-Tag | IGFaR | IR | IGFR/IR | IR/IGFR |
| | HLCVLEELFWGASLFGICSG | -- | -- | -- | -- | -- |
| 20C-3-A1-IR | RLCALEELFWGASLFGQCSG | 21.0 | 1.1 | 17.6 | 0.1 | 16.6 |
| 20C-3-C1-IR | HLCVLEELFWGAALFHQCSG | 30.6 | 1.4 | 21.9 | 0.1 | 16.1 |
| A6L-3-D2-IR | RLCVLEEQFWGASLFGQCSG | 7.0 | 1.1 | 14.9 | 0.1 | 14.1 |
| B6C-4-G12-IR | QLCVLEELFWGSSRLGYCSG | 31.1 | 2.5 | 33.5 | 0.1 | 13.6 |
| 96H-4-F9-IR | DLCVLEELFWGASLFGQCSG | 39.3 | 3.6 | 43.1 | 0.1 | 12.1 |
| J6C-4-E3-IR | QLCLLEEQFWGGSLFGQCSG | 34.6 | 5.3 | 40.0 | 0.1 | 7.6 |
| 20C-3-B10-IR | HLCVLEELFWGTSLFGQCSG | 29.9 | 16.9 | 31.7 | 0.5 | 1.9 |
| 20C-3-A3-IR | RLCVLEELVWGASLFDQCSR | 28.4 | 19.1 | 25.3 | 0.8 | 1.3 |

FIG. 2E-3

| Clone Design | Sequence XXXXXXXXXXXXXXXXXXX | Ratios over Background | | | Comparisons | |
|---|---|---|---|---|---|---|
| | | E-Tag | IGFaR | IR | IGFR/IR | IR/IGFR |
| R20α-3-20A4-IR | EIEAEWGRVRCLVYGRCVGG | 50.2 | 1.6 | 23.1 | 0.1 | 14.4 |
| R20β-4-A7-IR | EIEAEWGRVRCLVYGRCVGG | 44.2 | 1.3 | 24.0 | 0.1 | 18.5 |
| R20β-4-D8-IR | WLDQEWAWVQCEVYGRGCPS | 44.8 | 1.4 | 24.2 | 0.1 | 17.3 |

FIG. 3A

| Clone | Sequence | Ratios over Background | | | Comparisons | |
|---|---|---|---|---|---|---|
| Parental/Design | WLDQEWAWVQCEVYGRGCPS | E-Tag | IGFsR | IR | IGFR/IR | IR/IGFR |
| D815-4-A8-IR | WLDLEWAQVQCEVYGRGCPS | 44.8 | 1.4 | 24.2 | <0.1 | 17.3 |
| D815-4-D10-IR | WLDQEWAQVQCEVFGRGCPS | 48.0 | 1.0 | 48.4 | <0.1 | 48.4 |
| D815-4-D9-IR | WLDQEWQQVQCQVYGRGCTS | 49.2 | 1.0 | 48.2 | <0.1 | 48.2 |
| D815-4-A11-IR | RLDEEWARVQCEVWGRGCRS | 47.5 | 1.0 | 48.0 | <0.1 | 48.0 |
| D815-4-E12-IR | WLEQEWAWIQCEVYGRGCPS | 47.9 | 1.0 | 48.0 | <0.1 | 48.0 |
| D815-4-B7-IR | WLEQEWAQVQCEVYGRGCPS | 49.0 | 1.0 | 47.6 | <0.1 | 47.6 |
| D815-4-D11-IR | WLDEEWEWIQCKVYGRGCPA | 45.4 | 1.0 | 47.2 | <0.1 | 47.2 |
| D815-4-D12-IR | WLEQEWAWVQCEVYGRGCQS | 49.5 | 1.0 | 47.0 | <0.1 | 47.0 |
| D815-4-F8-IR | WLDQEWAWIQCEVYGRGCPA | 48.1 | 1.0 | 46.6 | <0.1 | 46.6 |
| D815-4-A9-IR | SLDWEWAWLQCEVYGRGCPS | 47.8 | 1.0 | 46.4 | <0.1 | 46.4 |
| D815-4-E9-IR | WLEQEWEQVRCLVYGRGCPP | 47.7 | 1.0 | 45.8 | <0.1 | 45.8 |
| D815-4-B10-IR | WLDQEWAWVQCEVYGRGCPY | 47.8 | 1.0 | 45.8 | <0.1 | 45.8 |
| D815-4-H8-IR | WLDQEWAGVLCEVYGRGCPS | 49.0 | 1.0 | 45.6 | <0.1 | 45.6 |
| D815-4-E10-IR | SLDKEWEWVLCVVYGRGCPS | 49.0 | 1.0 | 45.6 | <0.1 | 45.6 |
| D815-4-D7-IR | WLEQEWAQVQCEVYGRGCRS | 47.0 | 1.0 | 45.6 | <0.1 | 45.6 |
| D815-4-G9-IR | WLEEEWAQVQCAVYGRGCSS | 44.5 | 1.0 | 45.4 | <0.1 | 45.4 |
| D815-4-G12-IR | WLDQEWALVQCEVYGRGCPS | 44.2 | 1.0 | 44.2 | <0.1 | 44.2 |
| D815-4-E11-IR | WLDQEWAWVQCEVYGRGCAS | 44.3 | 1.0 | 43.7 | <0.1 | 43.7 |
| D815-4-H7-IR | WLEQEWAWVE*EVYGRRCPS | 45.5 | 1.0 | 43.0 | <0.1 | 43.0 |
| D815-4-F12-IR | WLDQEWAWVECQVYGRGCPS | 46.2 | 1.0 | 43.0 | <0.1 | 43.0 |
| D815-4-E8-IR | WLDQEWAWVQCEVYGRGCPS | 47.2 | 1.0 | 42.6 | <0.1 | 42.6 |
| D815-4-F9-IR | QLDQEWAWVLCKVYGRGCPS | 47.9 | 1.0 | 42.6 | <0.1 | 42.6 |
| D815-4-A10-IR | WLDHE*AWVQCEVYGRGCPS | 46.4 | 1.0 | 41.8 | <0.1 | 41.8 |
| D815-4-C7-IR | QLEQEWAWVRCEVYGRGCSS | 47.3 | 1.0 | 41.2 | <0.1 | 41.2 |
| D815-4-H10-IR | WLDQEWAWVRCEVYGRGCLS | 37.7 | 1.0 | 40.0 | <0.1 | 40.0 |
| D815-4-C9-IR | WLDQEWAWVRCEVYGLGCPS | 47.0 | 1.0 | 39.8 | <0.1 | 39.8 |
| D815-4-F11-IR | WLDQEWAVMKCELYGRGCPS | 44.2 | 1.0 | 39.8 | <0.1 | 39.8 |
| D815-4-H12-IR | WLEQEWAWVQCEVYGRGCLS | 40.4 | 1.0 | 39.2 | <0.1 | 39.2 |
| D815-4-A7-IR | SLDQEWAWVQCEVYGRGCLS | 45.4 | 1.0 | 38.6 | <0.1 | 38.6 |
| D815-4-H11-IR | WLDHEWAWVQCEVYGRGCTS | 37.3 | 1.0 | 37.3 | <0.1 | 37.3 |
| D815-4-F7-IR | WLDVEWAWVQCEVYGRGCPS | 2.4 | 1.0 | 37.2 | <0.1 | 37.2 |
|  |  | 32.4 | 1.0 | 34.7 | <0.1 | 34.7 |

FIG. 3B-1

| Clone | Sequence | Ratios over Background | | | Comparisons | |
|---|---|---|---|---|---|---|
| | | E-Tag | IGFsR | IR | IGFR/IR | IR/IGFR |
| Parental/Design | WLDQEWAWVQCEVYGRGCPS | -- | -- | -- | -- | -- |
| D815-4-G8-IR | QLDQEWARVRCEVWGRGCSS | 27.8 | 1.0 | 33.6 | <0.1 | 33.6 |
| D815-4-G7-IR | WLDLEWAQVQCKVYGRGCPS | 34.7 | 1.0 | 32.3 | <0.1 | 32.3 |
| D815-4-G11-IR | WLDEEWAWVQCQVYGRGCPS | 30.7 | 1.0 | 28.6 | <0.1 | 28.6 |
| D815-4-E7-IR | WLDQEWAWVQCEVWGRGCAF | 33.0 | 1.0 | 26.4 | <0.1 | 26.4 |
| D815-4-A12-IR | WLDREWAQVQCEVYGRGCLS | 28.4 | 1.0 | 19.0 | 0.1 | 19.0 |
| D815-4-B11-IR | WLDAEWEWVQCEVYGRGCRP | 22.1 | 1.0 | 18.8 | 0.1 | 18.8 |
| D815-4-D8-IR | SLDREWAYVQCQVYGRGCSS | 20.8 | 1.0 | 14.6 | 0.1 | 14.6 |

FIG. 3B-2

| Clone | Sequence | Ratios over Background | | | Comparisons | |
|---|---|---|---|---|---|---|
| Parental/Design | | E-Tag | IGFsR | IR | IGFR/IR | IR/IGFR |
| D820-3-H2-IR | WLDQEWAWVQCEVYGRGCPS | 44.8 | 1.4 | 24.2 | 0.1 | 17.2 |
| D820-3-C4-IR | RLDLEWANIQCEVYGRGCPS | 23.9 | 1.0 | 40.0 | <0.1 | 40.0 |
| D820-3-C3-IR | WLEQEWARVQCEVYGRGCSS | 31.0 | 1.0 | 39.5 | <0.1 | 39.5 |
| D820-3-G6-IR | WLEQEWILVECEVYGRGCPT | 35.2 | 1.0 | 39.4 | <0.1 | 39.4 |
| D820-3-D2-IR | WLDQEWAQVQCEVWGRGCPS | 33.8 | 1.0 | 38.8 | <0.1 | 38.8 |
| D820-3-D3-IR | WLDQEWEWIQCEVYGRGCPL | 35.6 | 1.0 | 37.8 | <0.1 | 37.8 |
| D820-3-B5-IR | LLDEEWAQIECEIYGRGCPS | 34.8 | 1.0 | 37.7 | <0.1 | 37.7 |
| D820-3-E2-IR | ALEEEWAWVQCEVYGRGCHF | 34.1 | 1.0 | 37.1 | <0.1 | 37.1 |
| D820-3-B3-IR | C?EQEWGLVQCEVYGRGCPS | 34.4 | 1.0 | 37.0 | <0.1 | 37.0 |
| D820-3-B6-IR | WLEQEWAYVQCEVYGRGCPS | 33.6 | 1.0 | 36.7 | <0.1 | 36.7 |
| D820-3-D4-IR | WLEHEWAQVQCEVWGRGCPY | 31.2 | 1.0 | 36.6 | <0.1 | 36.6 |
| D820-3-C2-IR | WLEQEWAEVRCEVYGRGCPR | 32.0 | 1.0 | 36.2 | <0.1 | 36.2 |
| D820-3-F6-IR | ?LEQEWAWVQCEVYGRGCPS | 33.7 | 1.0 | 35.6 | <0.1 | 35.6 |
| D820-3-D5-IR | WLEQEWAGIQCKVYGRGCPS | 30.8 | 1.0 | 35.2 | <0.1 | 35.2 |
| D820-3-F5-IR | RLEQEWAQVQCEVWGRGCLP | 30.5 | 1.0 | 34.8 | <0.1 | 34.8 |
| D820-3-H3-IR | QLDHEWAGIQCEVWGRGCPS | 29.8 | 1.0 | 34.6 | <0.1 | 34.6 |
| D820-3-G2-IR | WLEQEWAQIQCEVYGAGCRS | 30.2 | 1.0 | 33.8 | <0.1 | 33.8 |
| D820-3-H6-IR | SLEQEWAWVQCVVYGRGCPI | 31.3 | 1.0 | 33.0 | <0.1 | 33.0 |
| D820-3-F3-IR | WLEQEWDQVLCEVYGRGCPY | 30.3 | 1.0 | 32.2 | <0.1 | 32.2 |
| D820-3-B4-IR | WLEQEWAQV?CEVYGRGCA? | 28.6 | 1.0 | 30.7 | <0.1 | 30.7 |
| D820-3-C5-IR | WMDQEWAWVQCEVYGRGCPS | 33.1 | 1.0 | 30.5 | <0.1 | 30.5 |
| D820-3-F4-IR | QLDQEWAWIQCEVYGRNCRT | 29.1 | 1.0 | 30.3 | <0.1 | 30.3 |
| D820-3-H5-IR | TLEQEWAQVICEVYGRGCLS | 25.9 | 1.0 | 29.5 | <0.1 | 29.5 |
| D820-3-A6-IR | RLEQEWAQVQCEVWGRGCLS | 26.3 | 1.0 | 28.6 | <0.1 | 28.6 |
| D820-3-A2-IR | WLDQEWALVQCEVYGRGCPA | 24.8 | 1.0 | 26.0 | <0.1 | 26.0 |
| D820-3-G5-IR | WLDQEWAQIQCHVWGRGCPA | 23.7 | 1.0 | 25.6 | <0.1 | 25.6 |
| D820-3-G3-IR | WLEQEWAWVQCEVYGRGCPA | 22.6 | 1.0 | 25.0 | <0.1 | 25.0 |
| D820-3-E3-IR | RLEEEWAWVQCQVYGRGCPS | 22.2 | 1.0 | 23.9 | <0.1 | 23.9 |
| | WLEQEWVRIQCEVYGRGCPS | 20.6 | 1.0 | 22.7 | <0.1 | 22.7 |

FIG. 3C-1

| Clone Parental/Design | Sequence | Ratios over Background E-Tag | IGF1R | IR | Comparisons IGF1R/IR | IR/IGF1R |
|---|---|---|---|---|---|---|
| D820-3-E5-IR | WLDQEWAWVQCEVYGRGCPS | 44.8 | 1.4 | 24.2 | 0.1 | 17.2 |
| D820-3-D1-IR | WLEQEWTWVQCEVYGCGCPS | 25.9 | 1.0 | 22.6 | <0.1 | 22.6 |
| D820-3-E1-IR | WLEKEWAGVQCEIYGRGCPS | 27.3 | 1.0 | 22.4 | <0.1 | 22.4 |
| D820-3-F1-IR | WLEEEWAWVRCEVYGRGCQS | 22.4 | 1.0 | 21.9 | <0.1 | 21.9 |
| D820-3-B2-IR | WLEHEWAQIQCELYGRGCTY | 22.0 | 1.0 | 21.0 | <0.1 | 21.0 |
| D820-3-A3-IR | ALEEEWAWVQCEVYGRGCPS | 13.1 | 1.0 | 18.4 | 0.1 | 18.4 |
| D820-3-H4-IR | WLEQEWAQVQCEVYGRGCPS | 23.5 | 1.0 | 18.4 | 0.1 | 18.4 |
| D820-3-G1-IR | WLDDEWAQIQCEIYGRGCQS | 25.6 | 1.0 | 17.5 | 0.1 | 17.5 |
| D820-3-C1-IR | QLEEEWAGVQCEVYGRECPS | 14.5 | 1.0 | 16.3 | 0.1 | 16.3 |
| D820-3-A1-IR | WLEQEWLLVQCGVYGRGCPS | 27.8 | 1.0 | 13.9 | 0.1 | 13.9 |
| D820-3-A5-IR | WLDQEWAWIQCEVYGRGCRS | 14.7 | 1.0 | 12.8 | 0.1 | 12.8 |
| D820-3-H1-IR | WLEQEWAQVQCEVSGRGCPS | 6.4 | 1.0 | 6.3 | 0.2 | 6.3 |
| D820-3-A4-IR | W?DQEWALIQCEVYGRGCPS | 13.7 | 1.0 | 6.2 | 0.2 | 6.2 |
| D820-4-E12-IR | SLDEEWAGVLCEVYGRGCPF | 6.0 | 1.0 | 4.3 | 0.2 | 4.3 |
| D820-4-B12-IR | SVDQELEWLMCHFQGRVCPS | 34.9 | 9.0 | 10.9 | 0.8 | 1.2 |
| | WLEQERAWIWCEIQSGCRA | 32.2 | 8.6 | 1.0 | 8.6 | 0.1 |

FIG. 3C-2

| Clone Parental/Design | Sequence | Ratios over Background | | | Comparisons | |
|---|---|---|---|---|---|---|
| | | E-Tag | IGFsR | IR | IGFR/IR | IR/IGFR |
| D820-3-D5-IGFR | WLDQEWAWVQCEVYGRGCPS | 44.8 | 1.4 | 24.2 | 0.1 | 17.3 |
| D820-3-E4-IGFR | WVNQALGGVQSDVQGRRCQS | 29.6 | 3.8 | 1.0 | 3.8 | 0.3 |
| D820-3-C5-IGFR | LLDHEWPWVGCEVCGRGSLS | 27.1 | 3.2 | 1.0 | 3.2 | 0.3 |
| D820-3-F4-IGFR | WLHQELAWVRGEGYPRGRRS | 25.0 | 3.1 | 1.0 | 3.1 | 0.3 |
| D820-3-F6-IGFR | WLGHDWAWIQCEVYGLGCPC | 3.9 | 2.7 | 1.0 | 2.7 | 0.4 |
| D820-3-G4-IGFR | WIDQEGVRVQCEA*GRAFPS | 26.7 | 2.6 | 1.0 | 2.6 | 0.4 |
| D820-3-E2-IGFR | WRDEEWAWVQGVVQGRGWPA | 3.8 | 2.6 | 1.0 | 2.6 | 0.4 |
| D820-3-G6-IGFR | RLGVEWSWFQRKVYGRDSTS | 15.3 | 2.6 | 1.0 | 2.6 | 0.4 |
| D820-4-E11-IGFR | WLAQGWAGVQCVVYGRGCRN | 20.3 | 2.4 | 1.0 | 2.4 | 0.4 |
| D820-4-H11-IGFR | WLEEE*AGIQCQV?GRGCPS | 12.6 | 1.0 | 3.0 | 0.3 | 3.0 |
| D820-4-D11-IGFR | WLDQEWEWVQCEVWGRGCLS | 8.1 | 1.0 | 4.6 | 0.2 | 4.6 |
| D820-4-A8-IGFR | RLEQEWALIQCEVYGRGCPS | 4.5 | 1.0 | 5.3 | 0.2 | 5.3 |
| D820-4-F9-IGFR | WLEEEWAQVQCQVYGRGCAS | 3.2 | 1.0 | 5.5 | 0.2 | 5.5 |
| D820-4-C8-IGFR | WLDLE*EWLQCEVYGRGCAT | 9.4 | 1.0 | 5.8 | 0.2 | 5.8 |
| D820-4-D9-IGFR | WLEQEWVQVRCEVYGRGCPS | 11.6 | 1.0 | 5.9 | 0.2 | 5.9 |
| D820-4-D7-IGFR | WLEEEWAQVQCEVYGRGCPS | 10.1 | 1.0 | 8.9 | 0.1 | 8.9 |
| D820-4-H9-IGFR | WLDQEWARVQCEVWGRGCTY | 34.1 | 3.5 | 33.4 | 0.1 | 9.5 |
| D820-4-E10-IGFR | YLD?EWAWVQCEVYGLGCQS | 18.4 | 1.0 | 10.1 | 0.1 | 10.1 |
| D820-4-E7-IGFR | WLDVE*AWVQCEVWGRGCPS | 26.7 | 2.6 | 27.0 | 0.1 | 10.4 |
| D820-4-H8-IGFR | WLEQEWER?QCEVYGRGCPP | 31.9 | 3.0 | 32.2 | 0.1 | 10.7 |
| D820-4-A11-IGFR | WLEEEWAQVQCEVYGRGCLS | 16.1 | 1.0 | 11.7 | 0.1 | 11.7 |
| D820-4-C9-IGFR | WLDQEWAWIQCEVYGRGCPS | 8.0 | 1.0 | 12.5 | 0.1 | 12.5 |
| D820-4-E9-IGFR | ?LEHEWAQIDCEV?GRGCQS | 19.6 | 1.0 | 14.9 | 0.1 | 14.9 |
| D820-4-B10-IGFR | WL?QEWAWIQCEVYGRGCPF | 19.3 | 1.0 | 17.3 | 0.1 | 17.3 |
| D820-4-F10-IGFR | WLD?EWAWVQCEVYGRGCPS | 19.3 | 1.0 | 21.5 | <0.1 | 21.5 |
| D820-4-B9-IGFR | GLEQGCPWVGLEVQCRGCPS | 27.8 | 1.0 | 25.7 | <0.1 | 25.7 |
| D820-4-G8-IGFR | WLEEEWAWVQCEVYGHGCPS | 31.7 | 1.0 | 26.5 | <0.1 | 26.5 |
| | WLDQEWAQIQCEVYGRGCSS | 25.6 | 1.0 | 29.3 | <0.1 | 29.3 |

FIG. 3D-1

| Clone | Sequence | Ratios over Background | | | Comparisons | |
| --- | --- | --- | --- | --- | --- | --- |
| Parental/Design | | E-Tag | IGFsR | IR | IGFR/IR | IR/IGFR |
| D820-4-G9-IGFR | WLDQEWAWVQCEVYGRGCPS | 44.8 | 1.4 | 24.2 | 0.1 | 17.3 |
| D820-4-C10-IGFR | WLDQEWAQVQCEVWGRGCPS | 36.8 | 1.0 | 29.6 | <0.1 | 29.6 |
| D820-4-A9-IGFR | WLDLENEFVQCEVYGRGCPT | 32.6 | 1.0 | 31.3 | <0.1 | 31.3 |
| D820-4-B8-IGFR | WLEQEWASVQCEVYGRGCPS | 20.4 | 1.0 | 31.4 | <0.1 | 31.4 |
| D820-4-F8-IGFR | WLDLEWEQIKCKVYGRGCPF | 31.1 | 1.0 | 32.7 | <0.1 | 32.7 |
| D820-4-H7-IGFR | WLEQEWAQIQCQIYGRGCPS | 28.3 | 1.0 | 32.9 | <0.1 | 32.9 |
| D820-4-E8-IGFR | WLEQEWALVLCEVYGHGCPA | 34.1 | 1.0 | 32.9 | <0.1 | 32.9 |
| D820-4-G10-IGFR | WLEQEWAQIQCEVWGRGCSS | 26.6 | 1.0 | 33.2 | <0.1 | 33.2 |
| D820-4-D10-IGFR | WLE?EWEWVQCEVYGRGC?S | 37.5 | 1.0 | 33.2 | <0.1 | 33.2 |
| D820-4-D8-IGFR | WLEQEWAQVQCDVYGRGCPS | 36.6 | 1.0 | 33.5 | <0.1 | 33.5 |
| D820-4-A10-IGFR | WLEQE*ARVQCEVWGRGCPS | 23.7 | 1.0 | 34.6 | <0.1 | 34.6 |
| D820-4-B7-IGFR | WL?QEWARVHCEVWGRP?QC | 29.4 | 1.0 | 35.5 | <0.1 | 35.5 |
| D820-4-E12-IGFR | PLEHEWAWVQCVVYGRGCRS | 35.4 | 1.0 | 36.9 | <0.1 | 36.9 |
| D820-4-H10-IGFR | SLE?EWAWVQCEV?GRGCP? | 37.0 | 1.0 | 37.0 | <0.1 | 37.0 |
| D820-4-F12-IGFR | WLDQEWVRVQCEVWGRGCPS | 36.8 | 1.0 | 37.1 | <0.1 | 37.1 |
| D820-4-F7-IGFR | SLDKEWAWVKCEVYGRGCPS | 36.9 | 1.0 | 37.3 | <0.1 | 37.3 |
| D820-4-G12-IGFR | LGDQEWAWVEWEV$GRGWPS | 34.4 | 1.0 | 37.5 | <0.1 | 37.5 |
| D820-4-D12-IGFR | WLEEEWAQIRCGVYGRGCPS | 30.3 | 1.0 | 37.8 | <0.1 | 37.8 |
| D820-4-A12-IGFR | WLEEE*GWVQCEVWGRGCPP | 37.2 | 1.0 | 38.6 | <0.1 | 38.6 |
| D820-4-C12-IGFR | CLDQEWA?VQCPVYGRGCPS | 30.4 | 1.0 | 39.3 | <0.1 | 39.3 |
| D820-4-A7-IGFR | QLELEWARVQCEVWDRGCPS | 37.1 | 1.0 | 39.6 | <0.1 | 39.6 |
| D820-4-B12-IGFR | RLEQEWAWIQCEVYGRGCRF | 35.4 | 1.0 | 40.8 | <0.1 | 40.8 |
| ?820-4-B12-IGFR | SLEHE*AWVQCKVYGRGC?S | 36.2 | 1.0 | 41.4 | <0.1 | 41.4 |

FIG. 3D-2

| Clone | Sequence | Ratios over Background | | | Comparisons | |
| --- | --- | --- | --- | --- | --- | --- |
| Parental/Design | | E-Tag | IGFsR | IR | IGFR/IR | IR/IGFR |
| | WLDQEWAWVQCEVYGRGCPS | 44.8 | 1.4 | 24.2 | <0.1 | 17.3 |
| B6-4-G12-IR | WLDQEWAWIQCEVYGRGCPP | 4.4 | 1.0 | 6.9 | 0.1 | 7.1 |
| B6-3-A11-IR | WLDQEWAQVRCEVYGRGCPS | 7.3 | 1.0 | 6.3 | 0.2 | 6.3 |

FIG. 3E

FIG. 4A-1

| Clone Design | Sequence | | Ratios over Background | | | Comparisons | |
|---|---|---|---|---|---|---|---|
| | xxxxxxxxxxxxxxxxxxxx | | E-Tag | IGFaR | IR | IGFR/IR | IR/IGFR |
| R20-4-C10-IGFR | PKGTREFRGDVDWDGYSWLA | | 37.8 | 3.8 | -- | -- | -- |

FIG. 4A-2

| Clone Design | Sequence | Ratios over Background | | | Comparisons | |
|---|---|---|---|---|---|---|
| | xxxxxxxxxxxxxxxxxxxx | E-Tag | IGFaR | IR | IGFR/IR | IR/IGFR |
| 20F-4-B7-IGFR | TPIPAGGINIASWGGYTWLS | 10.9 | 3.7 | 0.5 | 7.3 | 0.1 |
| 20F-4-E4-IGFR | HRGTVTGVWVARWPGYEWLS | 8.9 | 4.7 | 0.7 | 6.3 | 0.2 |
| 20F-4-E12-IGFR | SDVWAQPQRRNDWPGYHWLS | 9.7 | 4.7 | 0.8 | 6.0 | 0.2 |
| 20F-4-F4-IGFR | HRGTVTGVWVARWPGYEWLS | 13.9 | 10.1 | 1.8 | 5.6 | 0.2 |
| 20F-4-F7-IGFR | SDVWAQPQRRNDWPGYHWLS | 13.7 | 3.9 | 0.8 | 5.1 | 0.2 |
| 20F-4-E7-IGFR | RPHRINPQDDAVWPGYLWLG | 7.2 | 2.5 | 0.5 | 4.7 | 0.2 |
| 20F-4-F11-IGFR | HRGTVTGVWVARWPGYEWLS | 17.6 | 16.2 | 3.5 | 4.6 | 0.2 |
| 20F-4-D10-IGFR | FGRGYGGDGGGYWSGYEWLA | 9.8 | 2.4 | 0.6 | 4.1 | 0.2 |
| 20F-4-B3-IGFR | DGLVVKSGREWPGYGWLER.A | 17.3 | 14.4 | 3.6 | 4.0 | 0.2 |
| 20F-4-B12-IGFR | DGSIV.VSSSVGWPGYEWLM | 10.1 | 9.9 | 2.4 | 4.0 | 0.2 |
| 20F-3-A9-IGFR | WQQANLSNGGRWGGYDWLM | 6.6 | 2.7 | 0.7 | 4.0 | 0.2 |
| 20F-4-G2-IGFR | FGRGYGGDGGGYWSGYEWLA | 5.1 | 1.3 | 0.5 | 4.0 | 0.2 |
| 20F-4-D11-IGFR | VNYEMDRVPMPWGGYWWLS | 5.0 | 1.0 | 0.5 | 2.7 | 0.4 |
| 20F-4-G4-IGFR | MGGGLWVGVHIWPGYSWLSQ | 3.9 | 0.9 | 0.5 | 2.3 | 0.4 |
| 20F-4-G12-IGFR | SDVWAQPQRRNDWPGYHWLS | 3.2 | 0.9 | 0.6 | 1.8 | 0.6 |
| | | | | | 1.5 | 0.7 |

FIG. 4B-1

| Clone Design | Sequence | Ratios over Background E-Tag | IGFsR | IR | Comparisons IGFR/IR | IR/IGFR |
|---|---|---|---|---|---|---|
| R20β-4-A4-IR | xxxxxxxxxxxxxxxxxx WPGYLFFEEALQDWRGSTED | 11.9 | 17.5 | 1.4 | 12.5 | 0.1 |
| R20β-4-F2-IR | SMFVAGSDRMPGYGVLADWL | 16.4 | 13.9 | 3.1 | 4.5 | 0.2 |
| R20β-4-E8-IR | VRGFQGGTVWPGYEWLRNAA | 41.0 | 34.9 | 3.6 | 9.7 | 0.1 |

FIG. 4B-2

| Clone Design | Sequence | Ratios over Background E-Tag | IGFsR | IR | Comparisons IGFR/IR | IR/IGFR |
|---|---|---|---|---|---|---|
| 20F-4-H10-IR | xxxxxxxxxxxxxxxxxx LDLASGDSWLGYDVLRGWLS | 10.2 | 3.1 | 2.4 | 1.3 | 0.8 |
| 20F-4-C10-IR | IHSSDGIGAWGGYAWFRDVA | 23.4 | 9.6 | 4.1 | 2.3 | 0.4 |

FIG. 4C

| Clone Design | Sequence | Ratios over Background E-Tag | IGFsR | IR | Comparisons IGFR/IR | IR/IGFR |
|---|---|---|---|---|---|---|
| R20β-4-D10-IR | xxxxxxxxxxxxxxxxxx LGPLLRWGSEVCGVWPDLCE | 21.5 | 1.0 | 8.0 | 0.1 | 8.0 |
| R20β-4-D9b-IR | PFGFGGRWWGIPRMWWYRNS | 32.6 | 6.8 | 15.1 | 0.5 | 2.2 |
| R20β-4-H4-IR | WWWGGRNRWWLERWGLGGER | 11.6 | 1.7 | 3.6 | 0.5 | 2.1 |
| R20β-4-A2-IR | GRVALWGPVWPRWWFMSRPV | 17.1 | 2.6 | 5.2 | 0.5 | 2.0 |

| Clone Design | Sequence | Ratios over Background E-Tag | IGFsR | IR | Comparisons IGFR/IR | IR/IGFR |
|---|---|---|---|---|---|---|
| | xxxxxxxxxxxxxxxxxxxxxxxxxxxxxxxxxxxxxxxxxx | -- | -- | -- | -- | -- |
| R40-3-40A2-IR | RGTRTDRLWKSGGFAIVPRWPCFSYHCLVEWITKTGSPG | 44.6 | 1.5 | 2.7 | 0.6 | 1.8 |
| R40-4-40F10-IR | GRTSMAFVPPRHLQPELAPRPVRNHAWLVGGG | 46.4 | 1.9 | 2.1 | 0.9 | 1.1 |

FIG. 4D

| Clone Design | Sequence | Ratios over Background E-Tag | IGFsR | IR | Comparisons IGFR/IR | IR/IGFR |
|---|---|---|---|---|---|---|
| | xxxxxxxxxxxxxxxxxxx | -- | -- | -- | -- | -- |
| R20-4-F10-IGFR | CLGAGSFRAGILCLGGLPVS | 35.5 | 6.0 | -- | -- | -- |
| R20-4-F7-IGFR | GFWATACGGLQICEELGLKP | 29.1 | 4.7 | -- | -- | -- |
| 20-4-H9-IGFR | DLFCAYMAQALGLGQDLSCG | 25.7 | 3.0 | -- | -- | -- |
| R20-3-A4-IGFR | RHLLLPQIWIAS*GGWGMG | 15.6 | 2.7 | -- | -- | -- |

FIG. 4E

| Clone Design | Sequence xxxxxxxxxxxxxxxxxxxxxxxx | Ratios over Background E-Tag | IGFsR | IR | Comparisons IGFR/IR | IR/IGFR |
|---|---|---|---|---|---|---|
| 20C-3-H3-IGFR | DHRLCGTDEYLMQDLFVRGLCRLIW | 28.5 | 26.6 | 1.0 | 26.6 | <0.1 |
| 20C-3-F4-IGFR | GLLFCKQLFTLAGLQPEAGCVSSSR | 34.4 | 27.5 | 1.2 | 23.1 | <0.1 |
| 20C-4-C10-IGFR | IWIACLDELLRGQVWSSCRRRAPIG | 35.5 | 24.4 | 1.3 | 19.2 | 0.1 |
| 20C-3-G5-IGFR | DWLRCLGVILSGGLTELANTGCVQG | 29.3 | 21.1 | 1.1 | 18.7 | 0.1 |
| 20C-3-A2-IGFR | WFSFCLGGLLQAQEWSVWGRDVGCI | 33.9 | 18.3 | 1.1 | 16.9 | 0.1 |
| 20C-3-B4-IGFR | GYSWLRDVLMEKQAQLKREGSVGRQ | 39.8 | 29.1 | 1.9 | 15.2 | 0.1 |
| 20C-3-C6-IGFR | FLTRLLERLGLS*ERGEAGGPYAQA | 34.8 | 20.9 | 1.4 | 14.9 | 0.1 |
| 20C-3-E2-IGFR | FSGFCMGLERLSQVSLGYCGAGQGG | 34.8 | 28.1 | 2.0 | 14.2 | 0.1 |
| 20C-3-A3-IGFR | ISFRCQLFVLAGMHPCPVDVGGEGF | 33.7 | 14.3 | 1.2 | 12.4 | 0.1 |
| 20C-3-B1-IGFR | NTPNCSQDWGQESGFMALLALTCK | 30.2 | 9.8 | 0.9 | 11.2 | 0.1 |
| 20C-3-F5-IGFR | LQGFCELLATVTGVTGLGCLDYQPI | 35.5 | 31.9 | 3.9 | 8.2 | 0.1 |
| 20C-4-A7-IGFR | GSSICNLLARAQIVELALCEMGVQE | 33.3 | 19.3 | 2.8 | 6.9 | 0.1 |
| 20C-4-F8-IGFR | LSFACLLSQLSGVVLPDCLLGED | 30.5 | 27.7 | 5.3 | 5.2 | 0.2 |
| 20C-4-G11-IGFR | GEHFCQLLMSLCGDDCGPVNCGGGS | 24.7 | 13.3 | 2.8 | 4.7 | 0.2 |
| 20C-3-E1-IGFR | GWFECLLASLVTLQVPQGRSRASAVC | 34.0 | 5.1 | 1.6 | 3.1 | 0.3 |
| 20C-3-B6-IGFR | YRQECACSVGAVGFLCGLACLARSG | 37.3 | 32.8 | 13.7 | 2.4 | 0.4 |

FIG. 4F-1

| Clone Design | Sequence xxxxxxxxxxxxxxxxxxxxxxxxxxxxxxxxxxxxxxx | Ratios over Background E-Tag | IGFsR | IR | Comparisons IGFR/IR | IR/IGFR |
|---|---|---|---|---|---|---|
| 40F-4-D1-IGFR | LSCLAYSRHGIWRPSTDLGLGRSVGEGSVSTRWRGYDWFE | 4.9 | 4.6 | 0.3 | 13.1 | 0.1 |
| 40F-4-B1-IGFR | GLDHSDAVGVHLGFAWPA.ARGRWEAGGLEDTWAGYDWL | 4.1 | 3.0 | 0.2 | 13.1 | 0.1 |
| 40F-4-D10-IGFR | W.GYAWLS | 4.9 | 4.5 | 0.4 | 11.7 | 0.1 |
| 40F-3-A3-IGFR | LSCLAYSRHGIWRPSTDLGLGRSVGEGSVSTRWRGYDWFE | 2.6 | 2.0 | 0.3 | 7.9 | 0.1 |
| 40F-4-C4-IGFR | EAMAVGLQCPARFVRAAAHGDGGSWGQDHV.AWGGYWWLG | 3.8 | 2.0 | 0.5 | 4.1 | 0.2 |

FIG. 4F-2

| Clone | Sequence | Ratios over Background | | | Comparisons | |
|---|---|---|---|---|---|---|
| Parental/D sign | | E-Tag | IGFsR | IR | IGFR/IR | IR/IGFR |
| F815-4-G11-IGFR | HLCVLEELFWGASLFGYCSG | 39.1 | 1.8 | 27.7 | 0.1 | 15.4 |
| F815-3-D1-IGFR | HFYVIVERLSGASLFGSGSA | 34.6 | 7.9 | 1.0 | 7.9 | 0.1 |
| F815-4-C12-IGFR | HRFVREGLLWGAYQFCYCSG | 14.9 | 1.0 | 2.0 | 0.5 | 2.0 |
| F815-4-A11-IGFR | FQSLLEELVWGAPLFRYGTG | 35.2 | 1.0 | 2.0 | 0.5 | 2.0 |
| | HLSVLEELSWGASLFGQWAG | 5.4 | 1.0 | 2.1 | 0.5 | 2.1 |

FIG. 4G

| Clone | Sequence | Ratios over Background | | | Comparisons | |
|---|---|---|---|---|---|---|
| Parental/D sign | | E-Tag | IGFsR | IR | IGFR/IR | IR/IGFR |
| NNKH-4-A9-IR | HLSVLEELSWGASLFGQWAG | 5.4 | 1.0 | 2.1 | 0.5 | 2.1 |
| NNKH-4-H4-IR | NLCRLEELAWGASLFGQCAG | 16.3 | 1.0 | 2.7 | 0.4 | 2.6 |
| NNKH-4-B3-IR | APVSTEELRWGALLFGQWAG | 15.6 | 1.0 | 2.6 | 0.4 | 2.5 |
| NNKH-4-E1-IR | HLSVLEERWWRESLFGQWAG | 13.6 | 2.8 | 6.7 | 0.4 | 2.3 |
| NNKH-4-E7-IR | HLSVLEERWWRAALFGQWAG | 13.9 | 4.8 | 9.5 | 0.5 | 2.0 |
| NNKH-4-G3-IR | HLSILEEQWWRESLFGQWAG | 16.9 | 1.3 | 2.3 | 0.6 | 1.8 |
| NNKH-4-B6-IR | HMSVEELSWWASLFGKQAG | 11.3 | 1.3 | 2.3 | 0.6 | 1.7 |
| NNKH-4-A10-IR | HLSELEERWWRATLFGQWAG | 13.2 | 1.3 | 2.1 | 0.6 | 1.7 |
| NNKH-4-A5-IR | HLSVLEELWWRESLFGQWAG | 15.4 | 2.0 | 3.2 | 0.6 | 1.6 |
| NNKH-4-F11-IR | HLSLLEEQWWRESLFGQWAG | 14.6 | 4.6 | 6.9 | 0.7 | 1.5 |
| NNKH-4-C9-IR | HLSVLEERWWRETLFGQWAG | 14.0 | 3.1 | 3.9 | 0.8 | 1.3 |
| NNKH-4-D12-IR | HLSVLEEQWWRESLFGQWAG | 14.3 | 2.3 | 2.9 | 0.8 | 1.2 |
| NNKH-4-D10-IR | HLSVLEEQWW.ESLFGQWAG | 12.0 | 1.4 | 1.7 | 0.8 | 1.2 |
| NNKH-4-E5-IR | HLSVLEELWWREALFGQWAG | 13.6 | 1.2 | 1.5 | 0.8 | 1.1 |
| NNKH-4-A6-IR | HLSVLEERWWRATLFGEWAG | 14.5 | 1.4 | 1.6 | 0.9 | 1.1 |
| NNKH-4-F6-IR | HL.VLEELLWGVSLFRQWAG | 8.4 | 1.4 | 1.5 | 1.0 | 1.1 |
| NNKH-4-C7-IR | HLSALEEQWWRATLFGESGQ | 14.1 | 2.8 | 2.9 | 1.0 | 1.0 |
| NNKH-4-F7-IR | HLSVLEERWWRATILESSGQ | 14.7 | 1.4 | 1.4 | 1.0 | 1.0 |
| NNKH-4-F8-IR | HLSALEELWWRETLFGQWAG | 14.1 | 7.5 | 7.0 | 1.1 | 0.9 |
| NNKH-4-E9-IR | HLSVLEELWWRESLFGKWAG | 13.6 | 11.0 | 8.6 | 1.3 | 0.8 |
| NNKH-4-E6-IR | HLSVLEEAWWRESLFGHWAG | 15.5 | 7.9 | 6.0 | 1.3 | 0.8 |
| NNKH-4-B7-IR | HMSEQEELMWWRATLFGQWAG | 18.2 | 3.8 | 2.7 | 1.4 | 0.7 |
| NNKH-2-B3-IR | HLSVLEERWWRETLFGEWAG | 16.5 | 12.9 | 8.2 | 1.7 | 0.6 |
| | HRSVLKQLSWGASLFGQWAG | 11.5 | 5.3 | 0.7 | 7.4 | 0.1 |

FIG. 4H

| Clone Parental/Design | Sequence | Ratios over Background E-Tag | IGFaR | IR | Comparisons IGFR/IR | IR/IGFR |
|---|---|---|---|---|---|---|
| NNKH-2-C5-IGFR | HLSVLEELSWGASLFGQWAG | 5.4 | 1.0 | 2.1 | 0.5 | 2.1 |
| NNKH-2-D9-IGFR | HL*VLEELSWGASLVGQWAV | 7.3 | 0.9 | 0.7 | 1.3 | 0.8 |
| NNKH-2-H12-IGFR | HLSVLEEL*LGASMFGLWAG | 4.1 | 0.5 | 0.4 | 1.3 | 0.8 |
| NNKH-2-D10-IGFR | HLSVLKELSW*ASLFGQWAG | 5.0 | 1.3 | 1.1 | 1.2 | 0.8 |
| NNKH-2-G9-IGFR | HLSALEELSWGASLFGQWAG | 4.8 | 2.1 | 1.9 | 1.1 | 0.9 |
| NNKH-2-C6-IGFR | HLSVLAELS*GALLFGQWAG | 1.9 | 1.4 | 1.3 | 1.1 | 0.9 |
| NNKH-2-C7-IGFR | RLSVLEQLSWGASLFGPWAG | 18.2 | 1.0 | 0.9 | 1.1 | 0.9 |
| NNKH-2-F11-IGFR | HL*VLVQPSWGASLFGQWAG | 21.8 | 1.3 | 1.3 | 1.0 | 1.0 |
| NNKH-2-H3-IGFR | HQSVLEELSR*ASLFGQWAG | 6.7 | 1.3 | 1.4 | 0.9 | 1.1 |
| NNKH-2-B8-IGFR | DMSVLGGLSWGA*LFGQWSG | 4.7 | 0.7 | 0.8 | 0.9 | 1.1 |
| NNKH-2-B12-IGFR | HLSVREGQLWRASMFGRWAG | 17.5 | 3.7 | 5.2 | 0.7 | 1.4 |
| NNKH-2-F9-IGFR | QLSVLVEL*WGASLFGPWAA | 1.2 | 1.0 | 2.9 | 0.3 | 2.9 |
| | HLSVGEELSW*VALLGQWAR | 3.7 | 0.6 | 2.1 | 0.3 | 3.5 |

FIG. 41

| D Name | Clonal Name | Formula # | K4(μM) HIR | PO4 | Fat Cell Assay | Activity | K4(μM) HIGFR | Ratio IGF/IR | Sequence |
|---|---|---|---|---|---|---|---|---|---|
| D101 | 20D3 | 1 | 0.51<br>0.27 | | | | 13<br>11 | 25<br>41 | KIGGQGHQDGNPYDWFVEALAKK (ε-biotin) |
| D102 | 20D1 | 1 | 1.2<br>0.97 | | | | 7.4<br>16 | 6.2<br>16 | KVLQARHGCDSVSDCFYEWFAKK (ε-biotin) |
| D103 | B8 | 1 | 0.74 | | | | 15 | 20 | KWSALLSVMDTGFYAWFDDAVKK (ε-biotin) |
| D104 | E7 | 1 | 20 | | | | >20 | >1 | KGHSWALVRHVDRLFYEWFDLKK (ε-biotin) |
| D105 | H8 | 1 | 2.8 | | | | 12 | 4.3 | KRDKPTDOEEQNWSFYEWFRHKK (ε-biotin) |
| D106 | 20F1 | 1 | 0.97 | | | | 6.2 | 6.4 | KVFWNCRSQOLDFYEWWFEQAAKK (ε-biotin) |
| D107 | 40G11 | 1 | 1.1 | YES | | Antagonist | 9.7 | 8.8 | KLESHYWPQAALDRLFYSWFSKK (ε-biotin) |
| D108 | 3G11 | 1 | 2.3 | | | Antagonist | 19 | 8.3 | KFYGWFSRQLSLTPRDDWGLPKK (ε-biotin) |
| D109 | 20H1 | 1 | 3.6 | | | Antagonist | 12 | 3.3 | KSAPGLVSNKODGLFYSWFREKK (ε-biotin) |
| D110 | G3 | 1 | 0.84 | | | Antagonist | 1.4 | 1.7 | KRGGGTFYEWFESALRKHGAGKK (ε-biotin) |
| D111 | D2 | 1 | 0.62 | | | | 3.2 | 5.2 | KDPERMQSDVGFYEWFRAAVGKK (ε-biotin) |
| D112 | IGFR C1<br>A65-4-C1 | 1 | 0.49<br>0.19 | | | Neutral | 0.05*<br>0.02* | 0.1<br>0.1 | DYKDVFTSAVFHENFYDWFVRQVSKK (ε-biotin) |
| D113 | IGFR H2<br>A65-4-1+2 | 1 | 0.75 | | -20μM | Agonist | 5.4 | 7.2 | SAKNFYDWFVKK (ε-biotin) |
| D114 | IGFR A6 | 1 | 8.1 | | | Neutral | >20 | >2.5 | ADKNFYDWFMAAKK (ε-biotin) |
| D115 | IGFR D5 | 1 | 8.1 | | >20μM | Agonist | >20 | >2.5 | DYKDLCOSWGVRIGWLAGLCPKK (ε-biotin) |
| D116 | IGFR JBA5 | 9 | 4.4 cycli | | -20μM | Agonist | 8.1 | 1.8 | FHENFYDWFVRQVSKK (ε-biotin) |
| D117 | IGFR H2C | 1 | 0.70 | YES | | | 6.1<br>5.1 | 8.6<br>8.5 | |
| D118 | 20E2 | 2 | 0.25 | YES | -20μM | Antagonist | 1.3 | 5.2 | DYKDFYOAIDOLVRGSABAGCTRDKK (ε-biotin) |
| D119 | 20C11 | 2 | 0.25 | YES | -20μM | Antagonist | 13<br>2.5 | 2.9<br>0.8 | KORAFYNGLRDLVGAVYGAWDKK (ε-biotin) |
| D120 | E8 | 10 | 0.37 | | | Antagonist | 2.2 | 5.9 | KVRGFQGGTWPGYEWLRNAAKK (ε-biotin) |
| D121 | F2 | 10 | 1.1 | | | Antagonist | 7.4 | 6.7 | KSMFVAGSDRWPGYGVLADWLKK (ε-biotin) |
| D122 | 20A4 (A7) | 6 | 1.2<br>1.0 | | | Antagonist | >20<br>>20 | >17<br>>20 | KEIEAEWGRVRCLVYGRCVGKK (ε-biotin) |
| D123 | D8 | 6 | 0.55<br>1.3 | | | Antagonist | 16<br>>20 | 29<br>>15 | KWLDQEWAWVQCEVYGRGCPSKK (ε-biotin) |
| D124 | F8 | 4 | 0.04*<br>0.09* | | | | 8.2<br>>20 | 200<br>>200 | KHLCVLEELFWGASLFGYCSGKK (ε-biotin) |
| D125 | IGFR E4 | 1 | 2.6 | | | | >20 | >8 | DYKDERSAAGFRGNFYDWFVAQVNKK (ε-biotin) |
| D126 | IGFR D2C | 1 | 1.4 | | | | 18 | 13 | LGENFYDWFVQVRKK |

FIG. 5A

| Clonal Name | D or S name | Motif | Sequence | IR-Kd | IR-IC50 Biocore | IR-IC50FP-S175 | PO4 | Fat Cell Assay |
|---|---|---|---|---|---|---|---|---|
| 20-E2 | | | DYKDFYDAIDQLVRGSARAGGTRDK K-biotin | | | | | |
| C1 | D118 | B6 | DYKDCWARPCGDAANFYDWFVQQAS KK-biotin | | | 2.8 nM | + | ++ |
| D8 | D112 | A6 | KWLDQEWAWVQCEYYCRGCPSKK | 250 nM | | | - | - |
| E8 | D123 | C-C LOOP | KRGFQCGTWIPGYEWLRNA | 490 nM | | | 0 | 0 |
| F8 | D120 | GROUP 6 | KHLCVLEELFWCASLFGYCSGKK | 550 nM | | | - | - |
| H2C | D124 | C-C LOOP | FHENFYDWFRQQVSKK | 370 nM | | | - | - |
| KCF9 | D117 | A6 | RLYYEWFWGQLEAQGRGGLS | 40 nM | >5 µM | 5 nM | ++ | ++ |
| KCG2 | | C-C | GIEQGCPWWGLEVQCRGCPS | 700 nM | | | | |
| KCG7 | | B6 | PYCGLEELSWCAALFGYCSG | | | | | |
| NG-C2 | | B6 | GNGDGMFYQLLSLLVGRDMH | | >1 µM | | | |
| NG-G3 | | A6 | GHSQSCPESFYDWFAGQVSDPWYCW | | 2-4 µM | 4.2 nM | +++ | |
| NG-C8 | | B6 | VEGRGLFYDLLRQLLARRQNG | | >5 µM | | - | - |
| NG-G9 | | B6 | RAMSFYDALWLGLGPKK-Biotin | | | | | |
| RP-1 | | A6 | GSRPVFHEQFYEWFVDQLGL | | 1 µM | | +- | |
| RP-2 | | A6 | RSEASFRVEFYSWFEEQLRS | | 1 µM | | - | |
| RP-3 | | B6 | GRFYGWFQDAIDQLMPWGFD | | >10 µM | | - | |
| RP-4 | | B6 | PPWCARFYDAIEQLVFDNL | | 5 µM | | + | |
| RP-5 | | B6+ | AGVNAGFYRYFSILLDWWDQGKK-Biotin | | 6 µM | | | |
| RP-6 | | C-C | TFYSCLASLLTGTPQPNRCPWERCRKK-Biotin | | | | +++++ | |
| RP-7 | | A6 | AAVHEQFYDWFADQYKK | | | | | |
| RP-8 | | B6 | QSFYDYIEELLGGEWKK | | | | | |
| RP-8J | S287 | B6 | QSFYDYIEELLGGEWEE | | >5 µM | | + | |
| RP-9 | | A6 | GSLDESFYDWFERQLGKK | | | 2.9 nM | ++ | |
| RP-10 | | B6 | GSFYEALQRLVCGCGKK | | >10 µM | | ++ | |
| RP-11 | | B6 | QAPSNFYDWVREWDKK | | >10 µM | | + | |
| RP-12 | | A6 | DPFYQGLWEWLRESGKK | | | | | |
| RP-13 | | B6 | ASGFPENFYDWFGROLSLKK | | >10 µM | | | |
| RP-14 | | B6 | SACQFDCHENFYDWFAROKK | | >10 µM | | | |
| RP-15 | | A6 | SQACSAPYAWFDQVLRTVKK | | >10 µM | | | |
| RP-16 | | B6 | V.DARDDIFLJIJL-SE-VTLL | | | | | |
| RP-17 | | B6 | QSDAFYSGLWALIGLSDCKK | | | | | |
| RP-18 | | B6 | LQPCSGFYDYFWQRLHLGSKK | | | | | |
| RP-19 | | A6 | LKQGFYDYFWQRLHLGSKK | | | | | |
| RP-20 | | B6 | GSASEYDAIDRLLRMRIKK | | | | | |
| RP-24 | | GROUP 6 | WPGYLFFEEALQDWRGSTED | | | | | |
| S167 | S167 | A6 | AFYDWFAKK | | No Binding | | | |
| S173 | S173 | A6 | LDALDRLLMRYEERPSL | >20 µM | | | | |
| S174 | S174 | RB6 | PLAELWAYFEHSEQGRSSAH | 12 µM | | | | |
| S175 | S175 | RB6 | GRYDWLQRNANFYDWFVAELG | 16 nM | 2-4 µM | 0.9 nM | ++ | 0 |
| S176 | S176 | A6 | NGYERACTGDNFYDWFVAQLH | 230 nM | | | | +++ |
| | | | | 470 nM | | | | |

FIG. 5B

Group 1 (Formula 1 Motif)

|  | Sequence | Found | Target IR | Target IGF |
|---|---|---|---|---|
| 20D3* | IGGQGQHQDGNFYDWFVEALA | 18 | + | +++ |
| 20F1 | VEWNCRSQQLDFYEWFEQAA | 16 | + | +++ |
| G3 | RGGTFYEWFESALRKHGAG | 8 | + | +++ |
| 20H1 | RVAGAISAPGLVSNKQDGLFYSWFE | 5 | + | +++ |
| 20D1* | VLQARHGCDSVSDCFYEWEA | 4 | + | +++ |
| D2 | DPERMQSDVGFYEWFRAAVG | 3 | + | +++ |
| B8 | WSALLSVMDTGFYAWFDDAV | 2 | ++ | +++ |
| C4 | DIGSDGHGRRWDSFYRWFEM | 2 | + | +++ |
| A8 | IGGSFVEFYGWENDQV | 2 | + | ++ |
| E7 | GHSWALVRHVDRLFYEWFDL | 1 | ++ | +++ |
| C8 | LPAGGAQGFAVRGFYEWFES | 1 | + | +++ |
| H8 | RDKPTDQEEQNWSFYEWFRH | 1 | + | +++ |
| E2 | SRDQTNFTFNSAGFYGWFER | 1 | + | ++ |
| B12 | GAFYRWFHEALVGSERVPDV | 1 | + | ++ |
| D10-2 | RIGGGWARSEGFYEWFVREL | 1 | + | ++ |
| G8 | RMFYEWFWSQMGAGPTEGSA | 1 | + | ++ |
| H3 | HEAFYDWFSALVDGGYELMG | 1 | + | ++ |
| 3G11 | FYGWFSRQLSLTPRDDWGLP | 1 | + | ++ |
| F4 | GVGTLTMSSDAFYTWFV | 1 | + | + |
| E7-2 | LGTSAGQGVGHRAFYQWFQS | 1 | + | +++ |
| 40G11 | <---ETLESHYVVPQ------------AALDRLFYSWFS | 3 | + | ++ |
| 40B2 | IRDMHYVWVQDRDRYINGVRQWYISDRYNPGSAFYRWFID | 2 | + | ++ |
| 40B12 | RMGLQALAHYRKSA------GPIFLSSGSVIKGSEGDPFYAWFRLQ | 1 | + | ++ |

FIG. 8

Group 2: Formula 6 Motif

| | | Target | |
|---|---|---|---|
| | Found | IR | IGF |
| 20A4* | EIEAEWGRVRCLVYGRCVGG | 13 | +++ | 0 |
| D8 | WLDQEWAWVQCEVYGRGCPS | 3 | +++ | ? |

Group 3: Formula 2 Motif

| | | Target | |
|---|---|---|---|
| | Found | IR | IGF |
| 20E2 | DYKDFYDAIDQLVRGSARAGGTRD | 1 | + | ++++ |
| 20C11 | DYKDDRAFYNGLRDLVGAVYGAWD | 1 | + | ++++ |
| 20A12 | DYKDRLFYCGIQALGANLGYSGCV | 1 | + | ++++ |
| C6 | DYKDFYSALWGLCGVTGCG | 1 | + | +++ |
| A6 | RGQSDAFYSGLWALIGLSDG | 1 | + | +++ |
| 40H4 | RYFPFGGFYGNLDVLRWLRPYVASPRWGHWRPGGSLGKQPT | 1 | + | 0 |

Group 5: Miscellaneous Motif 10

| | | Target | |
|---|---|---|---|
| | Found | IR | IGF |
| D9-2 | PFGFGGRWWGIPRMWYRNS | 1 | ++ | ++ |
| H4 | WWWGGRNRWWLERWGLGGER | 1 | + | + |

FIG. 9A

Group 4 and 6: Miscellaneous Motif 10

| | | Found | Target IR | IGF |
|---|---|---|---|---|
| D10 | LGPLLRWGSEVCGVWPDLCE | 3 | ++ | 0 |
| A2 | GRVALWGPVWPRWWFMSRPV | 1 | ++ | + |
| F2 | SMFVAGSDRWPGYGVLADWL | 1 | ++ | ++ |
| E8 | VRGFQGGTVWPGYEWLRNAA | 1 | ++ | ? |
| A4 | WPGYLFEEALQDWRGSTED | 1 | 0 | +++ |

Group 7: Formula 4 Motif

| | | Found | Target IR | IGF |
|---|---|---|---|---|
| B6 | ACSSFFVKGPEGFLQCLGSI | 1 | 0 | ++ |
| F8 | HLCVLEELFWGASLFGYCSG | 4 | +++ | + |
| 40D6 | PERGRGLRTAMQLMRRPRDWHFPHSLFWGAPPPLSG | 1 | 0 | 0 |

FIG. 9B

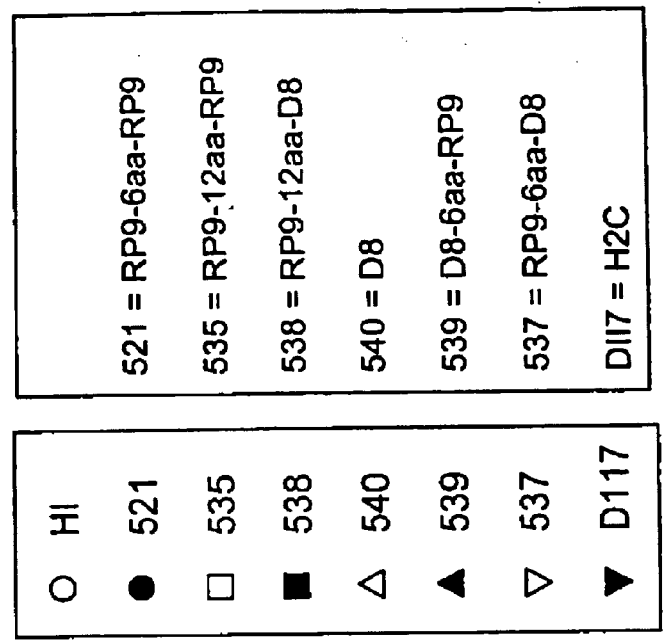
FIG. 10B | FIG. 10C
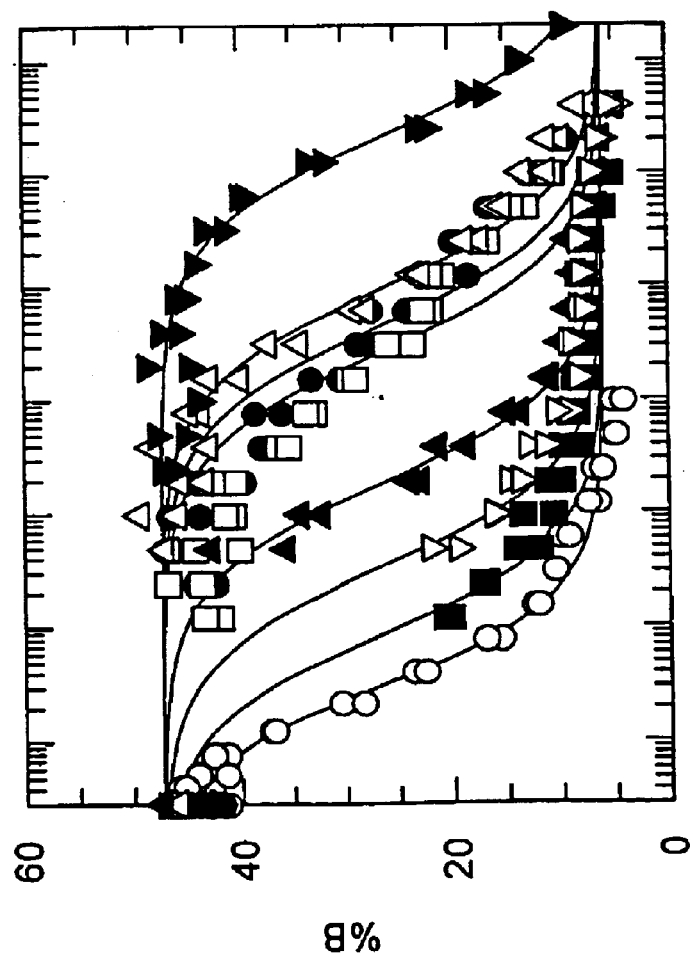
FIG. 10A

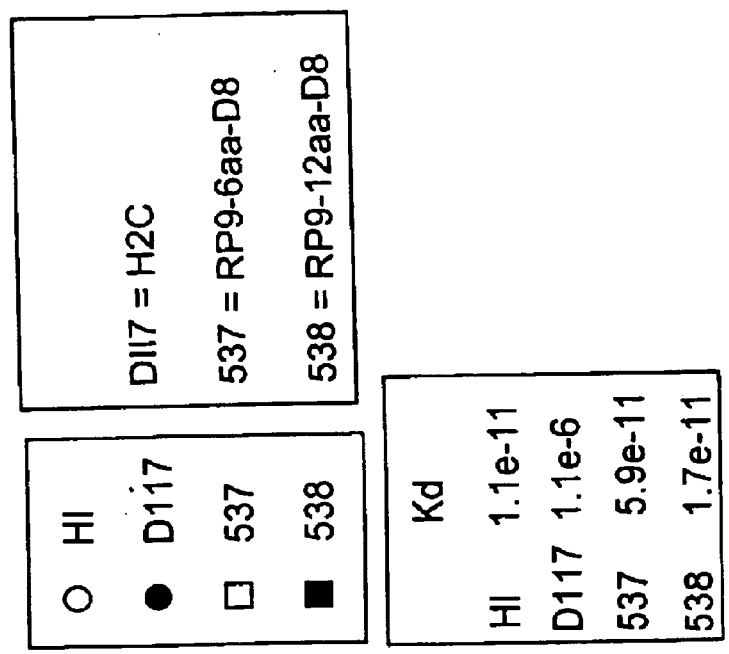
FIG. 11C
D117 = H2C
537 = RP9-6aa-D8
538 = RP9-12aa-D8
FIG. 11B
○ HI
● D117
□ 537
■ 538
FIG. 11D
| | Kd |
|---|---|
| HI | 1.1e-11 |
| D117 | 1.1e-6 |
| 537 | 5.9e-11 |
| 538 | 1.7e-11 |
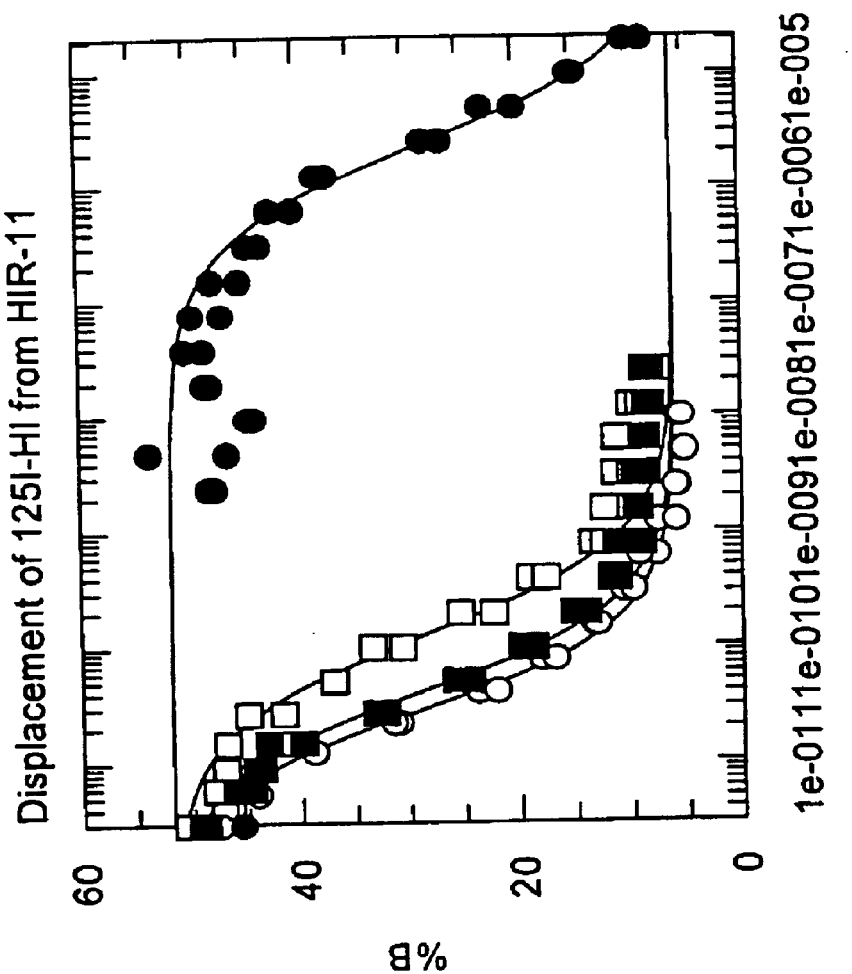
FIG. 11A

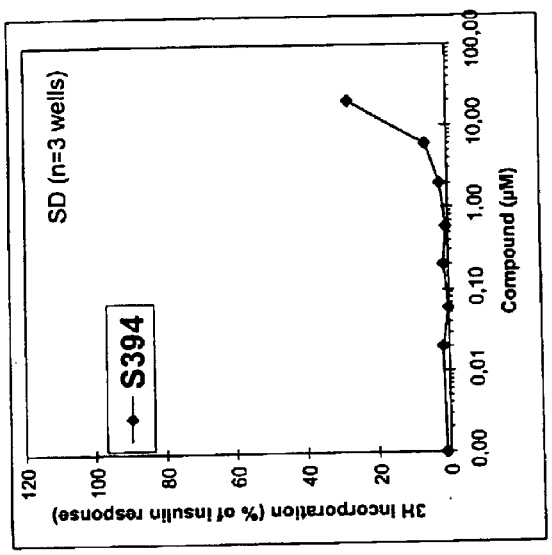
FIG. 12B
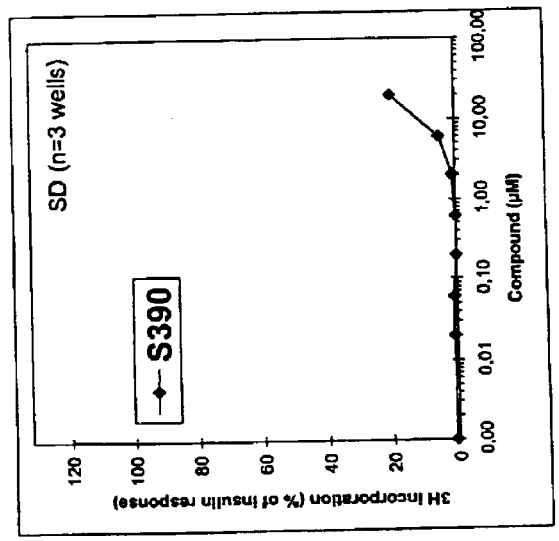
FIG. 12A
S390 =   ESFYDWFERQLG
S394 = GSLDESFYDWFERQ
FIG. 12C

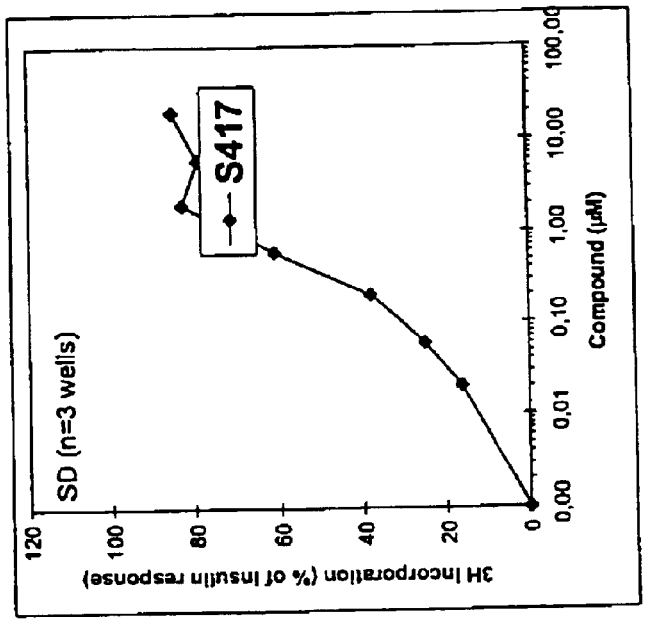
FIG. 13B
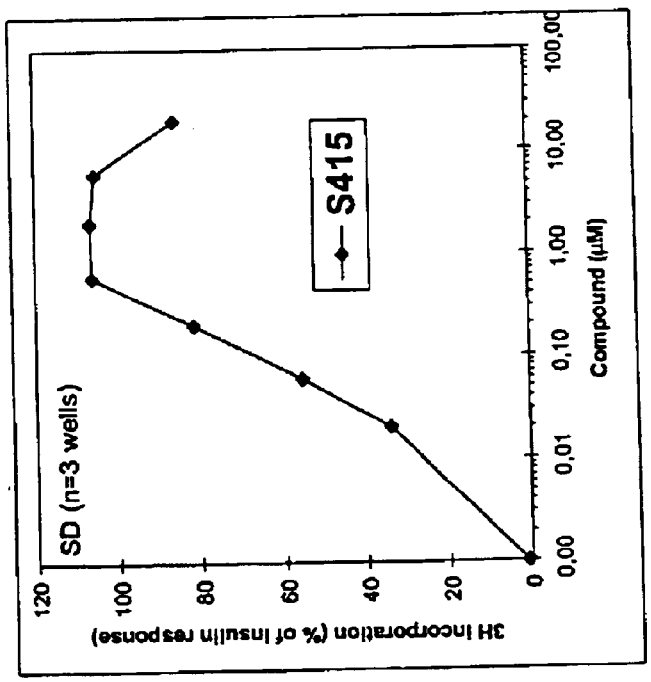
FIG. 13A
| S415 | (ESFYDWFERQLGK)₂-23 |
| S417 | 23-(ESFYDWFERQLG)₂ |
FIG. 13C

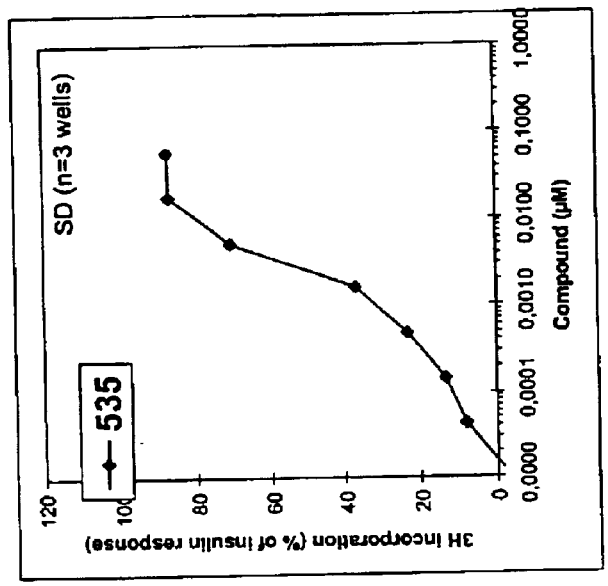
FIG. 14A
FIG. 14B
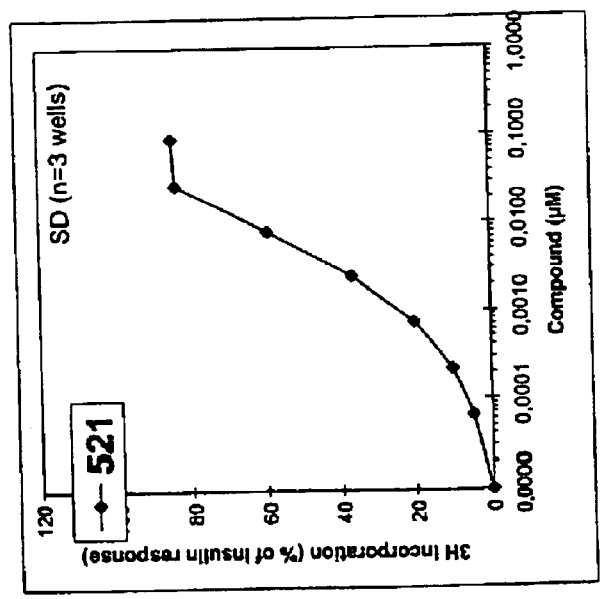
FIG. 14C
521 = RP9-6aa-RP9
535 = RP9-12aa-RP9

537 = RP9-6aa-D8
538 = RP9-12aa-D8

FIG. 16A
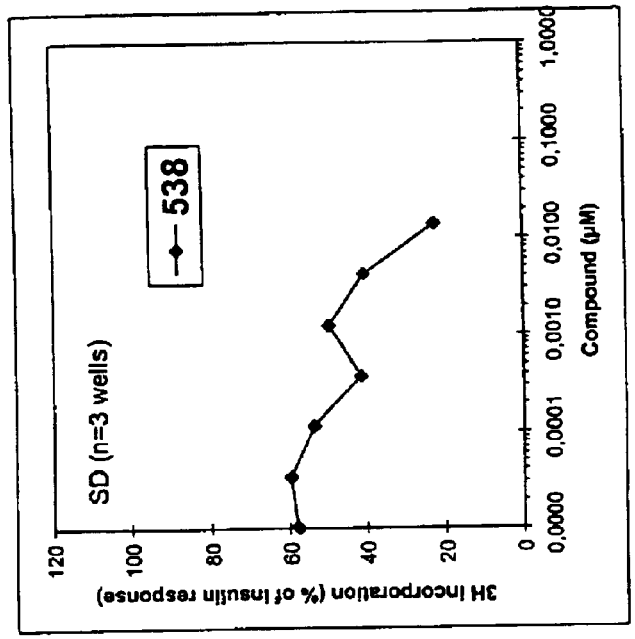
FIG. 16B
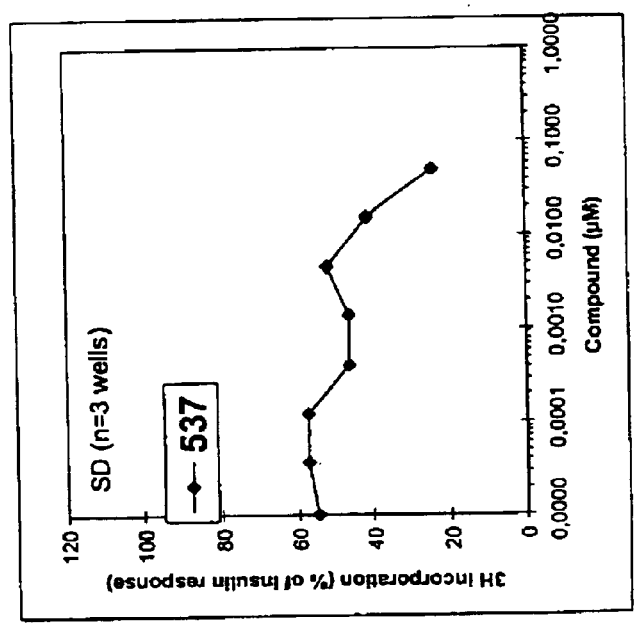
FIG. 16C
537 = RP9-6aa-D8
538 = RP9-12aa-D8

539 = D8-6aa-RP9

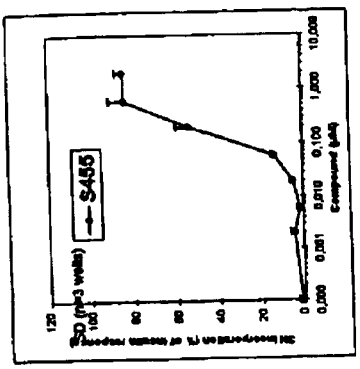 
FIG. 18A  C-N
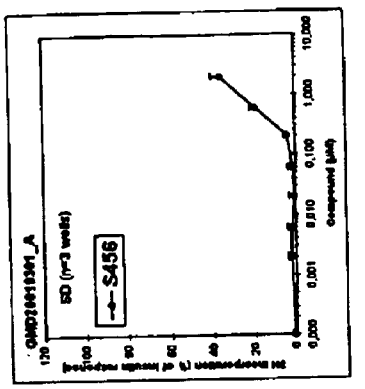 
FIG. 18B  N-N
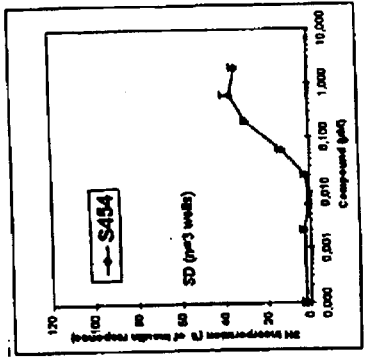 
FIG. 18C  C-C
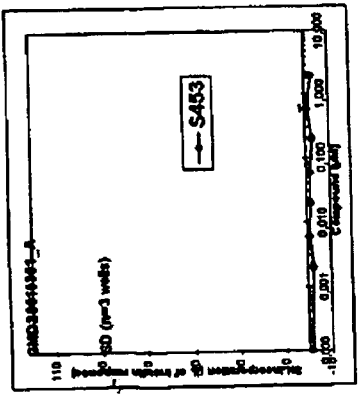 
FIG. 18D  C-N

| EC50 | Insulin | 521 | 535 | 539 |
|---|---|---|---|---|
| | 4.4680e-010 | 1.4420e-006 | 9.6490e-007 | 1.1000e-007 |

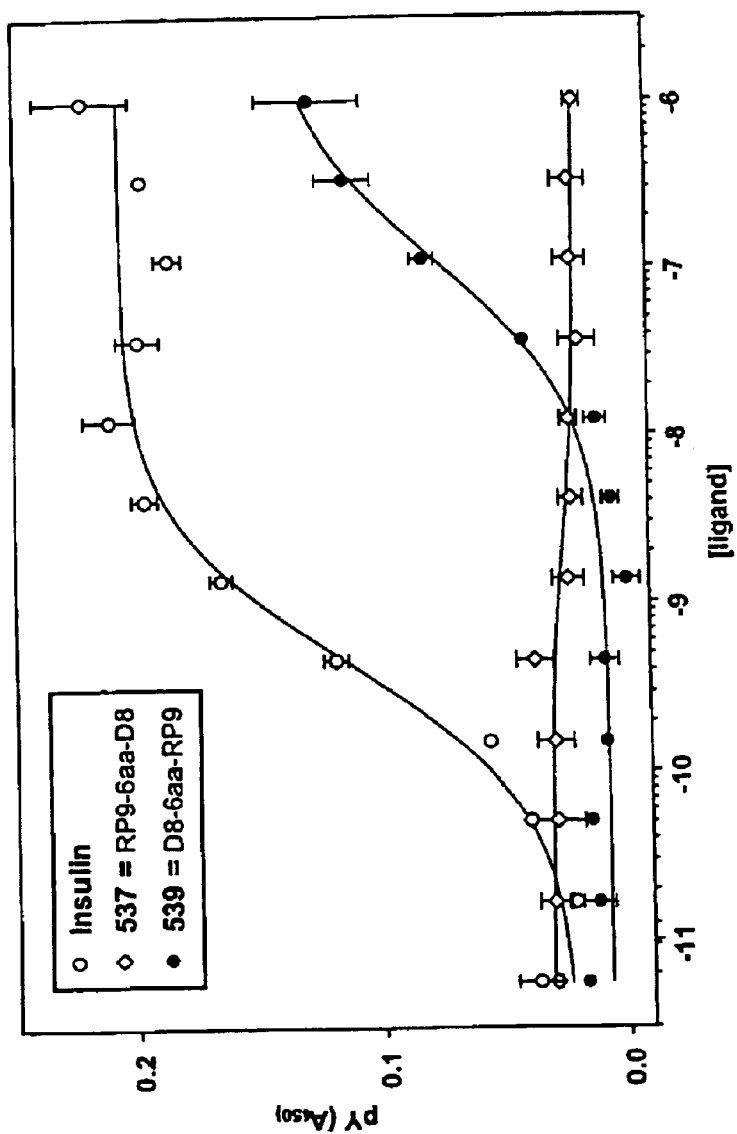

| Symbol | Peptide or Dimer | Sequence |
|---|---|---|
| △ | H2C | FHENFYDWFVQRVSKK |
| □ | S291 | (Lig-GGG-H2C)$_2$-9 |
| ▼ | RP9 | GSLDESFYDWFERQLGKK |
| ■ | S375 | (RP9-Lig)-14-(RP9-Lig) |
| ◇ | S337 | (RP9-Lig)$_2$-23 |
| ○ | S391 | truncated-(-GSLDE)RP9(-KK) |
| ● | S390 | truncated(-GSLD)RP9(-KK) |
| ⊙ | S414 | (truncated(-GSLD)RP9(-KK))$_2$-14 |
| ◆ | S175 | GRVDWLQRNANFYDWFVAELG |
| ▲ | S380 | (EE-short-S175-Lig)$_2$-9 |
| ▽ | Linker 23 | |

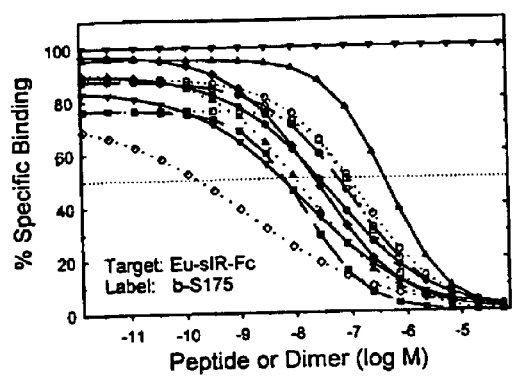
FIG. 23A
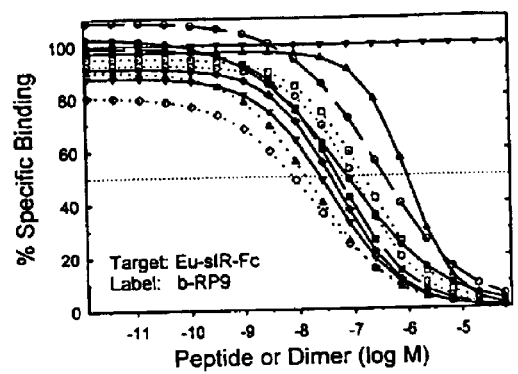
FIG. 23B
| Symbol | Peptide or Dimer | Sequence |
|---|---|---|
| △ | H2C | FHENFYDWFVQRVSKK |
| □ | S291 | (Lig-GGG-H2C)₂-9 |
| ▼ | RP9 | GSLDESFYDWFERQLGKK |
| ■ | S375 | (RP9-Lig)-14-(RP9-Lig) |
| ◇ | S337 | (RP9-Lig)₂-23 |
| ○ | S391 | truncated-(-GSLDE)RP9(-KK) |
| ● | S390 | truncated(-GSLD)RP9(-KK) |
| ○ | S414 | (truncated(-GSLD)RP9(-KK))₂-14 |
| ◆ | S175 | GRVDWLQRNANFYDWFVAELG |
| ▲ | S380 | (EE-short-S175-Lig)₂-9 |
| ▽ | Linker 23 | |
FIG. 23C

| Symbol | Peptide or Dimer | Sequence |
|---|---|---|
| △ | H2C | FHENFYDWFVQRVSKK |
| □ | S291 | (Lig-GGG-H2C)$_2$-9 |
| ▼ | RP9 | GSLDESFYDWFERQLGKK |
| ■ | S375 | (RP9-Lig)-14-(RP9-Lig) |
| ◇ | S337 | (RP9-Lig)$_2$-23 |
| ○ | S391 | truncated-(-GSLDE)RP9(-KK) |
| ● | S390 | truncated(-GSLD)RP9(-KK) |
| ⊙ | S414 | (truncated(-GSLD)RP9(-KK))$_2$-14 |
| ◆ | S175 | GRVDWLQRNANFYDWFVAELG |
| ▲ | S380 | (EE-short-S175-Lig)$_2$-9 |
| ▽ | Linker 23 | |

| Symbol | Peptide or Dimer | Sequence |
|---|---|---|
| △ | H2C | FHENFYDWFVQRVSKK |
| □ | S291 | (Lig-GGG-H2C)$_z$-9 |
| ▼ | RP9 | GSLDESFYDWFERQLGKK |
| ■ | S375 | (RP9-Lig)-14-(RP9-Lig) |
| ◇ | S337 | (RP9-Lig)$_z$-23 |
| ○ | S391 | truncated-(-GSLDE)RP9(-KK) |
| ● | S390 | truncated(-GSLD)RP9(-KK) |
| ○ | S414 | (truncated(-GSLD)RP9(-KK))$_z$-14 |
| ◆ | S175 | GRVDWLQRNANFYDWFVAELG |
| ▲ | S380 | (EE-short-S175-Lig)$_z$-9 |
| ▽ | Linker 23 | |

| Symbol | Peptide or Dimer | Sequence |
|---|---|---|
| △ | H2C | FHENFYDWFVQRVSKK |
| □ | S291 | (Lig-GGG-H2C)$_2$-9 |
| ▼ | RP9 | GSLDESFYDWFERQLGKK |
| ■ | S375 | (RP9-Lig)-14-(RP9-Lig) |
| ◇ | S337 | (RP9-Lig)$_2$-23 |
| ○ | S391 | truncated-(-GSLDE)RP9(-KK) |
| ● | S390 | truncated(-GSLD)RP9(-KK) |
| ○ | S414 | (truncated(-GSLD)RP9(-KK))$_2$-14 |
| ◆ | S175 | GRVDWLQRNANFYDWFVAELG |
| ▲ | S380 | (EE-short-S175-Lig)$_2$-9 |
| ▽ | Linker 23 | |

EC$_{50}$
Insulin: 0.050 nM
S519: 4.19 nM
S520: 58.8 nM

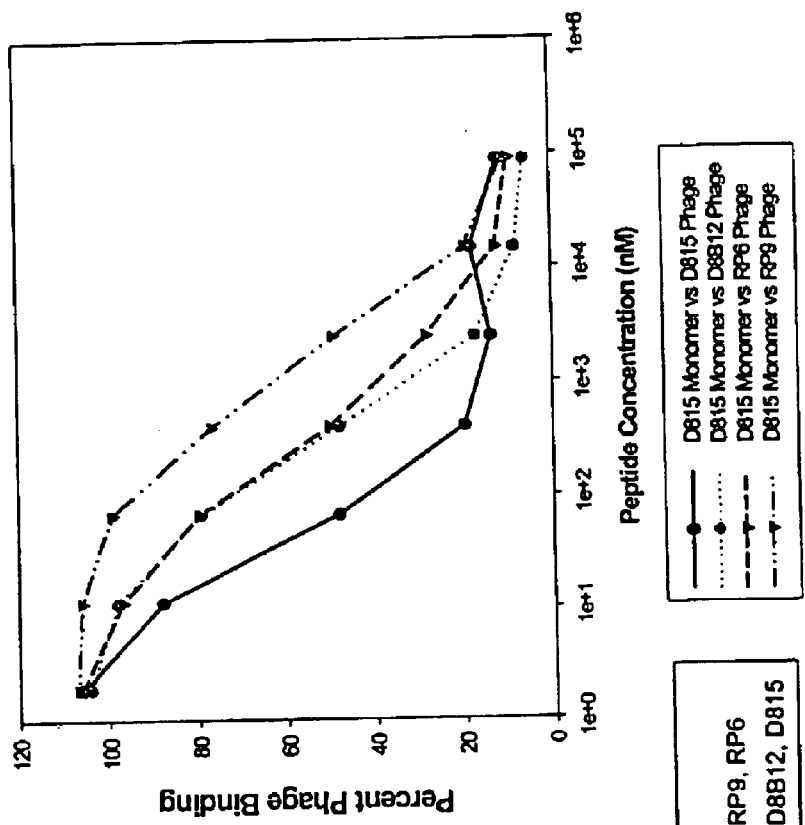
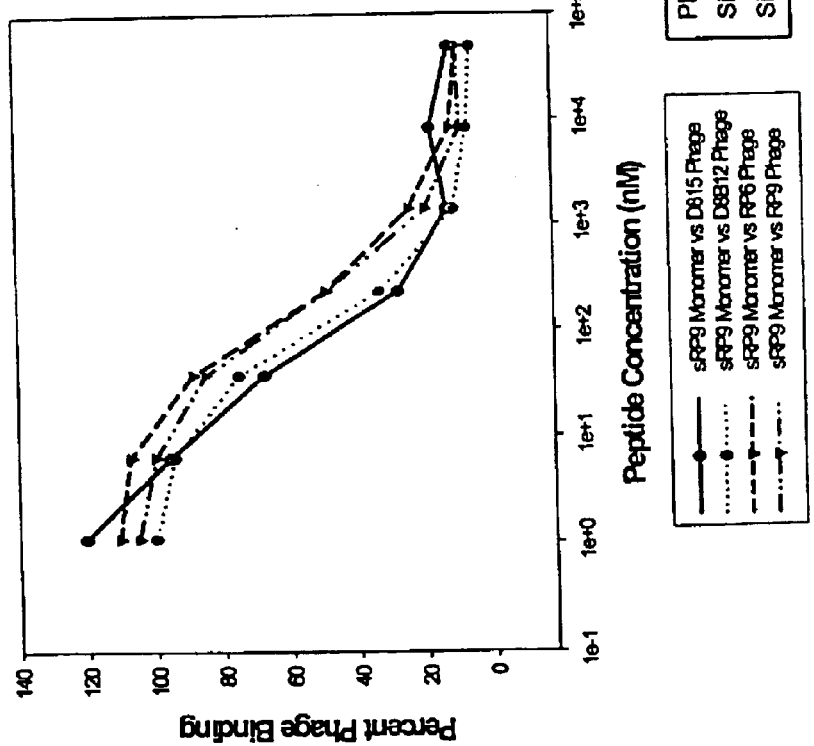

| Clone # | Sequence | Etag | IGFR | LDH | IGFR/LDH | Binder |
|---|---|---|---|---|---|---|
| IGFR-G33-4-A1 | | 15.5 | 10.3 | 1.1 | 9.5 | HIT |
| IGFR-G33-4-A2 | | 4.8 | 2.9 | 1.2 | 2.5 | HIT |
| IGFR-G33-4-A3 | | 14.9 | 16.1 | 1.5 | 10.6 | HIT |
| IGFR-G33-4-A4 | PAMAVGYPQPCAKSTYERGRGSALESRCYQAAAGAP | 8.6 | 5.4 | 1.3 | 4.3 | HIT |
| IGFR-G33-4-A5 | | 23.5 | 12.1 | 3.4 | 3.6 | HIT |
| IGFR-G33-4-A6 | | 10.8 | 5.2 | 1.2 | 4.4 | HIT |
| IGFR-G33-4-A7 | MC | 13.3 | 5.0 | 0.8 | 6.2 | HIT |
| IGFR-G33-4-A8 | PAMACKVC*CCSVSCYDGFPRSGAHPGRRWAAAGAP | 6.0 | 1.7 | 1.0 | 1.8 | CAND |
| IGFR-G33-4-A9 | PAMAFKVSLSCGESFYEWFAGLVRDPTCGWTAAAGAP | 10.8 | 6.3 | 1.1 | 5.7 | HIT |
| IGFR-G33-4-A10 | MC | 6.7 | 8.9 | 2.1 | 4.2 | HIT |
| IGFR-G33-4-A11 | AGHGACEFQVMFG*LVHLLGFPGRLGKGLAAGA | 5.8 | 5.8 | 1.2 | 4.9 | HIT |
| IGFR-G33-4-A12 | RPWRGSWLRLVGRRVECYCAERGATRGW*CAAAGAP | 3.3 | 2.6 | 1.1 | 2.4 | HIT |
| IGFR-G33-4-B1 | AGHGDFGALSCKAAVVAWVPVQTAGLRVRVAAAGAP | 8.1 | 3.2 | 1.2 | 2.6 | HIT |
| IGFR-G33-4-B2 | PAMAPRLYQGCPESFYAWTAGHVSPALYGWAAAGAP | 4.8 | 4.1 | 1.1 | 3.8 | HIT |
| IGFR-G33-4-B3 | PGHGVSVRAGVSGMLRREVAG#CVSAWEGLCGRRCA | 6.4 | 2.0 | 0.9 | 2.2 | CAND |
| IGFR-G33-4-B4 | PAMAGMDPQ#CTVASSRWFASPV#VVWRC#AAAGAP | 5.8 | 5.4 | 2.6 | 2.1 | HIT |
| IGFR-G33-4-B5 | PAMAGMFSQTCPEGFYGWFAGQASDSSLCRAAAGAP | 15.8 | 2.5 | 0.9 | 3.0 | HIT |
| IGFR-G33-4-B6 | PAMAPLGFRSCAGAY*VGCGRRVAFE#RCWAAAGAP | 7.7 | 2.3 | 1.2 | 1.9 | HIT |
| IGFR-G33-4-B7 | PAMAGILCPSCPHFLVDS#AAQDAAGQWPSAAAGAP | 7.2 | 3.3 | 1.2 | 2.8 | HIT |
| IGFR-G33-4-B8 | MC | 4.8 | 1.4 | 1.0 | 1.5 | HIT |
| IGFR-G33-4-B9 | PAMARRIPRECGDSFYVGLRWLVENPRSDWAAAGAP | 6.2 | 1.9 | 1.0 | 1.9 | CAND |
| IGFR-G33-4-B10 | PAMADRIGVQCPDSFYGWFAVQEPGTSGGLAAAGAP | 8.5 | 3.5 | 1.0 | 3.5 | HIT |
| IGFR-G33-4-B11 | PAMAGLPS*SCRVAMYKGQAAWSCSAAAGAP | 4.9 | 3.9 | 0.9 | 4.3 | HIT |
| IGFR-G33-4-B12 | RPWRLILVTLVREASMTGSGVWYPRRGGAGPAEGA | 3.6 | 2.6 | 1.0 | 2.5 | HIT |
| IGFR-G33-4-C1 | PAMAGSARQVCVDGVVGWREG*VVDQWL#RAAAGAP | 27.7 | 24.5 | 1.0 | 24.5 | HIT |
| IGFR-G33-4-C2 | PAMAGIMQRACEGGFTDCLWSLISGASSGRAAAGAP | 28.2 | 8.4 | 1.9 | 4.5 | HIT |
| IGFR-G33-4-C3 | PAMAGIMPQSCGETSGKCMRGQVSLRMRWSAAAGAP | 29.7 | 5.3 | 1.3 | 4.0 | HIT |
| IGFR-G33-4-C4 | RPWRVSSLRHVRVTCGELFGGQVSELFCLCAAAGAP | 7.5 | 5.6 | 1.1 | 5.0 | HIT |
| IGFR-G33-4-C5 | | 4.5 | 4.4 | 1.2 | 3.8 | HIT |
| IGFR-G33-4-C6 | PAMAGLIYMSCLAYFDDLIERRLEKPG#RFAAAGAP | 36.1 | 22.9 | 6.3 | 3.7 | HIT |
| IGFR-G33-4-C7 | PAMAGIMPQSCGETSGKCMRGQVSLRMRWSAAAGAP | 10.0 | 1.7 | 1.1 | 1.6 | CAND |
| IGFR-G33-4-C8 | PAMAFILPRSCEDYLYDFLASKVVHVFRSLAAAGAP | 9.7 | 6.9 | 1.9 | 3.6 | HIT |
| IGFR-G33-4-C9 | PAMACMSSQPCGESFYDWFAGQVRDPGWESAAAGA | 23.3 | 19.4 | 9.5 | 2.1 | HIT |
| IGFR-G33-4-C10 | RPWRGWAIRGVRHRC*GAWRGQVAQELCR#AAAGA | 30.2 | 9.3 | 4.3 | 2.2 | HIT |

FIG. 43A-1

| Clone # | Sequence | Etag | IGFR | LDH | IGFR/LDH | Binder |
|---|---|---|---|---|---|---|
| IGFR-G33-4-C11 | PAMAGIASHTCPGGFYEWFACQSRAPGWDGAAAGAP | 10.6 | 6.7 | 1.1 | 6.1 | HIT |
| IGFR-G33-4-C12 | | 19.2 | 30.2 | 5.2 | 5.9 | HIT |
| IGFR-G33-4-D1 | PAMAGRIARACPDSMFGWLAGGGSQQSGWQAAAGAP | 2.6 | 1.8 | 1.1 | 1.7 | CAND |
| IGFR-G33-4-D2 | PAMARPISPLC#RRSKDEDASRVSLPGFFCAAAGAP | 6.2 | 5.1 | 1.2 | 4.4 | HIT |
| IGFR-G33-4-D3 | MC | 31.0 | 8.5 | 1.0 | 8.3 | HIT |
| IGFR-G33-4-D4 | PAMADYKDDDDKTFYACLASLMAGTPRQYRTPWARCPAAAGAP | 4.8 | 1.7 | 1.1 | 1.5 | CAND |
| IGFR-G33-4-D5 | MC | 19.5 | 2.2 | 1.0 | 2.2 | HIT |
| IGFR-G33-4-D6 | RPWRVNTSESCL#FVCSLPSGYECWVGG*WAAAGAP | 3.4 | 1.1 | 1.0 | 1.1 | |
| IGFR-G33-4-D7 | PAMAGMGVQSCHDSFYGWFGCLFSDAEGDRAAAGAP | 20.7 | 15.2 | 7.0 | 2.2 | HIT |
| IGFR-G33-4-D8 | PAMAGDTSRACPESLNG.FCVVGVALRRWIAAAGAP | 20.1 | 7.0 | 1.0 | 7.1 | HIT |
| IGFR-G33-4-D9 | | 14.5 | 6.6 | 1.7 | 3.8 | HIT |
| IGFR-G33-4-D10 | PAMARWWRGLCGERWYHRGWVQVQFPWERGAAAGAP | 6.4 | 1.1 | 1.1 | 1.0 | |
| IGFR-G33-4-D11 | RPWRVPWVLEMPEYGNANLVFYDALQRLAAAGAP | 27.7 | 19.7 | 1.2 | 16.5 | HIT |
| IGFR-G33-4-D12 | AGHGVCYLAGVFGEALGGGRVSGFAIGQVRAAAGAP | 29.8 | 16.9 | 3.3 | 5.0 | HIT |
| IGFR-G33-4-E1 | PAMAGRIKEFCSRSFYDQVACLVKGPSWGGAAAGAP | 11.0 | 13.2 | 2.0 | 6.5 | HIT |
| IGFR-G33-4-E2 | PAMAGRIKEFCSRSFYDQVACLVKGPSWGGAAAGAP | 18.9 | 16.0 | 3.7 | 4.3 | HIT |
| IGFR-G33-4-E3 | PAMAGISSRSCAENLRFGRAWQGSDVWDCLAAAGAP | 22.4 | 21.3 | 0.9 | 22.9 | HIT |
| IGFR-G33-4-E4 | PAMASRIPQWCRDSFYEWFECQLLGPRESRAAAGAP | 14.5 | 7.3 | 1.2 | 6.1 | HIT |
| IGFR-G33-4-E5 | PAMAGAESCYRAKSFYDGLGCLVGEAWWGAAAGAP | 7.8 | 14.3 | 1.9 | 7.4 | HIT |
| IGFR-G33-4-E6 | PAMARSGAPRCHDPFYEWFAVEAQEPLRCEAAAGAP | 6.0 | 3.1 | 1.0 | 3.1 | HIT |
| IGFR-G33-4-E7 | PAMAGMGVQSCHDSFYGWFGCLFSDAEGDRAAAGAP | 13.9 | 13.9 | 1.9 | 7.4 | HIT |
| IGFR-G33-4-E8 | PAMADISFESCLAQLLGWRAGEGSKRLWRCAAAGAP | 11.9 | 17.1 | 3.5 | 4.9 | HIT |
| IGFR-G33-4-E9 | PAMANTFLYPCRDPFYHSLADLVGVAMQCGAAAGAP | 23.2 | 24.5 | 5.2 | 4.7 | HIT |
| IGFR-G33-4-E10 | PAMARRIPRECGDSFYAGLRCLVESPRSDWAAAGAP | 9.4 | 5.8 | 1.7 | 3.3 | HIT |
| IGFR-G33-4-E11 | PAMASIVCPFCEDSFYNWFAAQVADTRGLWAAAGAP | 24.1 | 33.5 | 10.1 | 3.3 | HIT |
| IGFR-G33-4-E12 | | 1.2 | 0.9 | 1.0 | 0.9 | |
| IGFR-G33-4-F1 | PAMAWSHSHAYTESYDWPAAQVLSAGSGRAAAGAP | 0.9 | 1.1 | 0.9 | 1.3 | |
| IGFR-G33-4-F2 | PAMAGRIKEFCSRSFYDQVACLVKGPSWGGAAAGAP | 7.2 | 8.5 | 0.9 | 9.7 | HIT |
| IGFR-G33-4-F3 | PAMARSRPPACGDSFYGWFECEVSGLGRRGAAAGAP | 2.2 | 1.4 | 1.0 | 1.4 | |
| IGFR-G33-4-F4 | PAMAGISYPACEEESFYDCLASLVLSPWGSGAAAGAP | 12.1 | 5.2 | 0.8 | 6.7 | HIT |
| IGFR-G33-4-F5 | PAMAGRIKEFCSRSFYDQVACLVKGPSWGGAAAGAP | 16.7 | 24.2 | 7.3 | 3.3 | HIT |
| IGFR-G33-4-F6 | PAMAVVAGQYCRDSFYDRLSALVGDAWRCGAAAGAP | 13.6 | 7.4 | 1.9 | 3.8 | HIT |
| IGFR-G33-4-F7 | PAMACTASRFCAVSFYEWFAAQLPDLGGDSAAAGAP | 12.5 | 16.9 | 1.2 | 13.8 | HIT |
| IGFR-G33-4-F8 | PAMAGITLQSCGGGFYELLASVVGDTGCRLAAAGAP | 20.2 | 10.9 | 1.0 | 11.3 | HIT |
| IGFR-G33-4-F9 | PAMAGYICRSCQGSFYGCLAALVRDPRCSRAAAGAP | 24.7 | 33.0 | 8.8 | 3.7 | HIT |
| IGFR-G33-4-F10 | PAMAGRIKEFCSRSFYDQVACLVKGPSWGGAAAGAP | 7.1 | 10.6 | 1.2 | 9.1 | HIT |
| IGFR-G33-4-F11 | RPWRVAGAPRCHDPFYEWFAVEAQEPLRCEAAAGAP | 1.0 | 1.0 | 0.8 | 1.2 | HIT |

FIG. 43A-2

| Clone # | Sequence | Etag | IGFR | LDH | IGFR/LDH | Binder |
|---|---|---|---|---|---|---|
| IGFR-G33-4-P12 | PAMAGMGVQSCHDSFYGWFGCLFSDAEGDRAAAGAP | 7.6 | 4.7 | 0.6 | 8.0 | HIT |
| IGFR-G33-4-G1 | PAMASICGQSCRDPFYAGLRGLLLEPLQLGAAAGAP | 17.6 | 18.5 | 1.0 | 19.5 | HIT |
| IGFR-G33-4-G2 | PAMAGVMSKCCSGSFYDWLADLVPEASWSWAAAGAP | 6.5 | 5.7 | 1.0 | 5.5 | HIT |
| IGFR-G33-4-G3 | PAMASFSGEACGGSFYDCLAGLMRDSSVSRAAAGAP | 18.4 | 7.9 | 1.1 | 7.4 | HIT |
| IGFR-G33-4-G4 | PAMASFSFYTCMETLLDGFGGQAFNRCRRTAAAGAP | 22.5 | 20.1 | 1.3 | 15.6 | HIT |
| IGFR-G33-4-G5 | PAMARVIYPTCPRDFYGGLAALVFGPHVCGAAAGAP | 22.8 | 21.7 | 1.9 | 11.5 | HIT |
| IGFR-G33-4-G6 | PAMAGIGSQACTDPFYYWFEGLVSNGGWCRAAAGAP | 5.9 | 5.3 | 1.2 | 4.3 | HIT |
| IGFR-G33-4-G7 | PAMAGRIKEFCSRSFYDQVACLVKGPSWGGAAAGAP | 18.8 | 2.1 | 1.0 | 2.1 | HIT |
| IGFR-G33-4-G8 | PAMAGAESCYRAKSFYDGLGCLVGEAWWGGAAAGAP | 23.6 | 30.3 | 3.7 | 8.2 | HIT |
| IGFR-G33-4-G9 | PAMADMMSQVCSQSMTGRFSVDFYDGLRCLAAAGAP | 17.3 | 4.6 | 0.9 | 5.1 | HIT |
| IGFR-G33-4-G10 | PAMARRIPRECGDSFYAGLRCLVESPRSDWAAAGAP | 26.8 | 24.6 | 5.4 | 4.6 | HIT |
| IGFR-G33-4-G11 | PAMARVIQEACGGSFYDGLACLVYPQGWRGAAAGAP | 3.3 | 1.5 | 0.9 | 1.7 | CAND |
| IGFR-G33-4-G12 | PAMAGGRSVACQESFYALLGCVVMGPGGGSAAAGAP | 24.1 | 32.1 | 12.1 | 2.7 | HIT |
| IGFR-G33-4-H1 | PAMAGISFRSCLQALIAGSAGNASEMGCRSAAAGAP | 5.9 | 5.8 | 1.2 | 4.8 | HIT |
| IGFR-G33-4-H2 | PAMAGIRDSYCQQGAFYDWFAGLVDDGLFCQAAAGAP | 9.2 | 4.4 | 1.0 | 4.4 | HIT |
| IGFR-G33-4-H3 | PAMAGISYQSCEDSFYAWFACTVLDTRGGGAAAGAP | 17.8 | 16.0 | 1.8 | 8.9 | HIT |
| IGFR-G33-4-H4 | PAMARVIYEACGGSFYDGLACLVYPQGWRGAAAGAP | 3.1 | 3.2 | 1.1 | 2.8 | HIT |
| IGFR-G33-4-H5 | PAMADMPLLECLDPFYSWFAGQVSDPRFCGAAAGAP | 20.1 | 7.5 | 0.9 | 8.0 | HIT |
| IGFR-G33-4-H6 | PAMARVIQEACGGSFYDGLACLVYPQGWRGAAAGAP | 5.1 | 2.4 | 0.8 | 2.9 | HIT |
| IGFR-G33-4-H7 | PAMAGRIKEFCSRSFYDQVACLVKGPSWGGAAAGAP | 12.9 | 11.1 | 1.1 | 9.8 | HIT |
| IGFR-G33-4-H8 | MC | 23.4 | 23.5 | 1.6 | 14.7 |  |
| IGFR-G33-4-H9 | PAMAHISFHSCLEALQDPEWGQPSAAWRNCAAAGAP | 1.2 | 1.1 | 0.8 | 1.3 | HIT |
| IGFR-G33-4-H10 | PAMAMTAQESCPDSFYECLAVLVGDRWGGWAAAGAP | 7.9 | 10.4 | 2.8 | 3.7 | HIT |
| IGFR-G33-4-H11 | PAMAHISFHSCLEALQDPEWGQPSAAWRNCAAAGAP | 16.8 | 23.7 | 1.3 | 18.1 | HIT |
| IGFR-G33-4-H12 | PAMAGTISQCCEENFYAGLAHLAGVGQWGCAAAGAP | 20.4 | 19.0 | 4.7 | 4.0 | HIT |

FIG. 43A-3

| Clone # | | E-Tag | IGFR | IR | Sp/Irr | Binders |
|---|---|---|---|---|---|---|
| B10 | DDDKTFYACLEFLLSGNPEGNSPWDRCR | 2.6 | 29.0 | 1.0 | 29.0 | HIT |
| D1 | MC | 17.0 | 26.8 | 1.1 | 25.1 | HIT |
| A4 | DDDKIFYSCLASLLHGGPQRNTGPWERCR | 25.2 | 25.6 | 1.0 | 25.6 | HIT |
| A6 | DDDKTFYSCLASLLTGPREQNRGAWERCR | 22.3 | 23.3 | 1.1 | 21.2 | HIT |
| B1 | DDDKSFYSCLASLLTASRLPSRGAWDGCH | 18.0 | 22.8 | 0.9 | 25.3 | HIT |
| E4 | DDDKSFYSCLGSLLTGAPQPIRGAWDRCR | 20.8 | 20.6 | 1.1 | 19.1 | HIT |
| C11 | DDDKSFYSCLASLWSGTGGSSRGRWEGCR | 22.7 | 20.4 | 1.3 | 16.2 | HIT |
| C2 | DDDKTFYSCLGALLAGTGERNLRPWGRCR | 19.9 | 19.1 | 1.0 | 19.1 | HIT |
| B6 | DDDKSFYSCLGSLLTGPSDPKRGPWGGCR | 22.6 | 19.0 | 1.2 | 15.3 | HIT |
| A12 | DDDKTFYKCLASVLTGSTQTKRRPWEGCR | 13.9 | 18.8 | 1.0 | 18.4 | HIT |
| D2 | DDDKPFYSCLATLLTDPPQSQRGAWGRCR | 22.5 | 17.2 | 1.1 | 16.1 | HIT |
| C1 | DDDKSFYSCLAALLTGSSQSSGGAWMLCR | 21.6 | 16.9 | 1.1 | 15.2 | HIT |
| F10 | DDDKSFYSCLASLVAGTPWPKGGSWERCR | 11.4 | 16.6 | 0.9 | 18.2 | HIT |
| B11 | DDDKSFYSCLASLVTGIPRSNSGTQVFCR | 7.8 | 16.1 | 0.8 | 20.8 | HIT |
| A9 | DDDKSFYSCMASLLTGTPESRRGMGERCG | 16.3 | 15.9 | 1.3 | 11.8 | HIT |
| A10 | DDDKAFYSCLASLLTGSPPAQGPWDRCR | 8.3 | 15.6 | 1.0 | 16.2 | HIT |
| B9 | DDDKFFYSCLASLLSDTPQRRGPGVRCR | 5.9 | 14.3 | 0.9 | 15.4 | HIT |
| A3 | DDDKTFYSCLASLLAGNPQPNRAGWEYCR | 14.1 | 13.3 | 0.9 | 15.1 | HIT |
| F2 | DDDKTFYSCLGSLLLGPPQKNPGPGERCR | 9.6 | 13.3 | 0.9 | 14.8 | HIT |
| A7 | DDDKMFYSCLESLLIGRWPRNGGSLSRCR | 10.9 | 13.2 | 1.1 | 12.5 | HIT |
| G3 | DDDKSFYSCLTFLLTGTPQANDASWERCR | 9.6 | 13.2 | 1.0 | 13.8 | HIT |
| A11 | DDDKSFYSCMAALLSGAPQKSRGRWERCG | 4.7 | 12.7 | 0.8 | 15.0 | HIT |
| B7 | DDDKAFYRCLAYLLAGRPQASGGGVRCR | 19.7 | 12.5 | 0.9 | 13.5 | HIT |
| D5 | DDDKAFYSCLAALRERSPQMSRGTWGGCR | 21.8 | 11.8 | 1.3 | 9.3 | HIT |
| E8 | DDDKTFYACLAALLGGTAELHDGSLECRG | 11.8 | 11.8 | 1.3 | 9.0 | HIT |
| D10 | DDDKTFYSCLGSLLTGTLPPARGARNICR | 15.1 | 11.6 | 1.0 | 11.6 | HIT |
| D8 | DDDKTFYSCLSSLLAGSPLPRRDLWAGCR | 11.1 | 9.2 | 0.9 | 10.6 | HIT |
| D12 | DDDKAFYSCMASLLAGTPEAQGSAWVRCR | 5.4 | 7.4 | 0.8 | 9.0 | HIT |
| A5 | DDDKNFYACMESLVSVAPPSSRDPFECRR | 16.0 | 7.3 | 1.3 | 5.5 | HIT |
| F6 | DDDKSFYSCLASLVSGTA.PNRGPWERCR | 4.2 | 6.9 | 1.0 | 7.1 | HIT |
| G5 | DDDKIFYSCLASLLDDTAQSRRGQWARCR | 4.8 | 6.4 | 1.3 | 5.1 | HIT |
| C6 | DDDKIFYSCLGALLSGTPQTSHVTSGRCR | 13.6 | 5.9 | 1.1 | 5.4 | HIT |

FIG. 43B-1

| Clone | # | E-Tag | IGFR | IR | Sp/Irr | Binders |
|---|---|---|---|---|---|---|
| D3 | TDDKTFYFCLASLLAGTQQQSRGAWERCG | 5.1 | 5.9 | 0.9 | 6.5 | HIT |
| A2 | DDDKAFYSCLASVLTGSPHPGRSRWERCR | 18.6 | 5.5 | 0.9 | 6.0 | HIT |
| B2 | DDDKTFYSCLESMLTGTPPPCRGHGERGR | 8.0 | 5.5 | 1.0 | 5.6 | HIT |
| D7 | DDDKTFESCLEALVSGGSRRERGLWYRCR | 10.6 | 5.5 | 1.1 | 5.1 | HIT |
| C12 | DDDKAFYSCLSSLLAGTRERHRDTWPRCG | 12.0 | 5.3 | 1.0 | 5.3 | HIT |
| B5 | DDDKTFHSCLAALVTGTPQQKRGPWERCR | 20.0 | 5.1 | 1.3 | 3.9 | HIT |
| E2 | DDDKTFYLCLASLQTVTRLGDRVPWERCR | 18.0 | 4.6 | 0.7 | 6.4 | HIT |
| F3 | DDDKTFYSCLVSLLNGTAKPNRGQWEGCR | 3.7 | 4.5 | 1.4 | 3.2 | HIT |
| H2 | DDDKSFYSCLASLSNCTPGLLRCQWERCR | 7.2 | 4.4 | 0.8 | 5.4 | HIT |
| B4 | DDDKTFYSCLSSLLASTPQPNRGAWLCRR | 11.9 | 4.3 | 1.2 | 3.6 | HIT |
| G12 | DDDKSFYSCLASLSNCTPGLLRCQWERCR | 2.2 | 4.2 | 1.0 | 4.4 | HIT |
| F5 | MC | 8.4 | 4.0 | 0.9 | 4.3 | HIT |
| A1 | DDDKTFYSCLGALLSGAPQTYRGPGAGCR | 8.1 | 3.9 | 1.0 | 3.9 | HIT |
| E11 | DDDKTFYSCLVSLLNGTAKPNRGQWEGCR | 4.9 | 3.8 | 1.0 | 3.9 | HIT |
| F9 | DDDKFYSCLSSLLTAPPQSTRGPAGRHC | 3.9 | 3.7 | 1.0 | 3.6 | HIT |
| E3 | DDDKFYSCLASLLNGNTQPNGGQWVRCR | 1.7 | 3.6 | 0.8 | 4.5 | HIT |
| G4 | DDDKVPYTCLASLSTGTPQRQSGEWQRCR | 9.4 | 3.3 | 1.3 | 2.5 | HIT |
| E5 | DDDKTFYSCLVSLLNGTAKPNRGQWEGCR | 4.6 | 3.2 | 0.9 | 3.7 | HIT |
| C10 | DDDKPFYSCLASLIQGTPLPERGMWERCR | 6.3 | 3.0 | 1.0 | 3.0 | HIT |
| C7 | MC | 10.6 | 2.9 | 1.0 | 3.0 | HIT |
| H5 | DDDKTFYSCVSWLLTGARQRDGVWERCR | 5.5 | 2.9 | 1.3 | 2.2 | HIT |
| H3 | DDDKTFYSCLVSLLNGTAKPNRGQWEGCR | 4.6 | 2.8 | 1.1 | 2.5 | HIT |
| C3 | DDDKAFYGCLAALLTGAROPSRGVGERCF | 6.0 | 2.7 | 1.5 | 1.8 | HIT |
| F1 | DDDKTFYSCLVSLLNGTAKPNRGQWEGCR | 1.5 | 2.6 | 0.8 | 3.4 | HIT |
| B3 | DDDKTFYSCLASLLAGSPQPKRAGWEYCR | 8.6 | 2.5 | 1.0 | 2.5 | HIT |
| D11 | DDDKPFYSCLESLVTGRPQADRGVWERCR | 4.9 | 2.4 | 0.9 | 2.7 | HIT |
| E10 | DDDKTFYSCLTSLSRGSAHGLSGRWERCR | 5.0 | 2.3 | 0.9 | 2.7 | HIT |
| F12 | DDDKTFYFCLATLLTGPPVPNREPWACYR | 2.5 | 2.2 | 0.8 | 2.7 | HIT |
| D4 | DDDKIFYSCLRTLGTNPPEPVRGPFDRCG | 3.0 | 2.1 | 1.1 | 1.9 | HIT |
| E6 | DDDKTFYSCLVSLLNGTAKPNRGQWEGCR | 2.7 | 2.1 | 1.4 | 1.5 | HIT |
| F11 | NDDKSPYSCVASLVNEGPSQVGVLGERCR | 3.5 | 2.1 | 1.2 | 1.7 | HIT |
| A8 | DDDKTFYSCLASMLTGPPHPDRVPWDRCR | 8.3 | 2.0 | 1.0 | 1.9 | HIT |
| A7 | DDDKTFYSCLVELVNGTSPPARGLWERCR | 2.7 | 2.0 | 1.0 | 2.1 | CAND |
| F8 | DDDKVFYSCLESLVSGTPEVNGRAWERCR | 2.0 | 1.8 | 1.0 | 1.7 | CAND |
| E12 | YDDKRFYYCLASLASGTLQTNREQWERCR | 1.0 | 1.7 | 1.0 | 1.7 | CAND |
| H1 | DDDKTFYSCLESLLNGTPQRNRGQWDPCS | 1.9 | 1.7 | 0.9 | 1.9 | CAND |
| H8 | DDDKTFYTCLQALLTGYERPVGGRWESCR | 1.2 | 1.7 | 1.2 | 1.4 | CAND |

FIG. 43B-2

| Clone # | | E-Tag | IGFR | IR | Sp/Irr | Binders |
|---|---|---|---|---|---|---|
| G9 | DDDKAFYSCLATLLYGNPPSSRGQWHRCR | 1.5 | 1.6 | 1.1 | 1.5 | CAND |
| D6 | DDDKVFYSCLESLVSGTPEVNGRAWERCR | 1.3 | 1.5 | 1.1 | 1.5 | CAND |
| H6 | GDDKTFYACLSSLLYGTADWSQGQRDRCR | 3.2 | 1.5 | 1.3 | 1.1 | |
| E7 | DDDKSPYSCMESLWTDTPQPNRGRWERCR | 3.2 | 1.4 | 1.1 | 1.3 | |
| F4 | DDDKTFYSCLASLLTVSPEPSRGPWERCR | 1.4 | 1.4 | 1.2 | 1.1 | |
| G6 | MC | 1.4 | 1.4 | 1.0 | 1.5 | |
| G11 | DDDKTFYSCMVQLLTGTPEKSCVTWERWR | 1.6 | 1.4 | 1.0 | 1.4 | |
| H4 | DDDKTFYSCLVSLLNGTAKPNRGQWEGCR | 4.7 | 1.4 | 1.0 | 1.4 | |
| B8 | DDDKTFYSCVASLVVGTAQPQCGPWQGWG | 9.1 | 1.3 | 1.4 | 1.3 | |
| C8 | DDDKTFYSCLAGLVTGPPRQNWGAGDACR | 7.7 | 1.3 | 0.9 | 1.0 | |
| E1 | DDDKTFYSCMSSLSTTAPQPKSGRMDRCR | 2.3 | 1.3 | 1.2 | 1.4 | |
| G10 | DDDKTFYSCLASLVNGSLQPNRAPGELCR | 1.2 | 1.3 | 1.0 | 1.2 | |
| H10 | DDDKTFYSCLVSLLNGTAKPNRGQWEGCR | 3.5 | 1.3 | 1.0 | 1.3 | |
| H11 | DDDKTFYSCLVSLLNGTAKPNRGQWEGCR | 2.6 | 1.2 | 0.9 | 1.3 | |
| D9 | DDDKSFYSCLESLLNGGPQQKRGPWEGCR | 1.1 | 1.2 | 1.1 | 1.3 | |
| E9 | DDDKTFYSCLASLLNGNTQPNGGQWVRCR | 1 | 1.1 | 1.1 | 1.1 | |
| C9 | MC6 | 0.9 | 1.1 | 0.9 | 1.0 | |
| G1 | DDDKSFYSCLASLSNCTPGLLRCQWERCR | 2.2 | 1.1 | 0.9 | 1.3 | |
| H7 | DDDKNFYSCLSALLNGNTVSDRGQGERCF | 2.2 | 1.1 | 0.9 | 1.0 | |
| H9 | DDTFYSCLASLVNGSPQAYGGPREHCR | 3.1 | 1.0 | 1.1 | 1.1 | |
| C5 | DDDKIFYSCLAWLMTGPAPPYRGPWSCWS | 3.3 | 1.0 | 0.9 | 1.0 | |
| G7 | DDDKIFYACLSSLSTGTWQPKRGPGERCR | 0.9 | 1.0 | 1.0 | 0.9 | |
| H12 | DDDKSFYSCLASLSNCTPGLLRCQWERCR | 3.7 | 0.9 | 0.9 | 1.1 | |
| C4 | DDDKTFYSCLGSLINGTPPHRGLWQGCR | 1.1 | 0.9 | 0.9 | 1.1 | |
| G8 | DDDKTFYSCLVSLLNGTAKPNRGQWEGCR | 0.7 | 0.8 | 1.0 | 0.9 | |
| G2 | DDDKQFYSCLAPLASGIAQPQPGAWELCR | 1.1 | 0.8 | 1.0 | 0.8 | |
| B12 | DDDKTFYCCLAALLTGAPPPKGGTCERCG | 9.3 | 13.2 | 0.7 | 18.3 | HIT |

FIG. 43B-3

| IR Clone | Sequence | E-Tag | IR | IGFR | IR/IGFR | IGFR/IR |
|---|---|---|---|---|---|---|
| B5 | FHENFYDWFARKDSGGSGGSGGSDLCVLEELFWGDSLFDYCTG | 17.0 | 16.9 | 0.5 | 35.8 | 0.0 |
| A3 | FHENF.DWFVRQVSGGSGGSGGSNLCVLEELFWGASLFGECSG | 13.0 | 11.8 | 0.3 | 35.8 | 0.0 |
| A8 | SHGNFSEWFVRQGYGGSGGSGGSDLCVLEELYWGASLFGYCSG | 13.2 | 13.1 | 0.4 | 33.2 | 0.0 |
| C7 | FQESFYDWFVR.VTGGSGGSGGSDLCGVEDLVWGSALSGYCAG | 15.1 | 14.7 | 0.5 | 30.6 | 0.0 |
| B4 | FHENFNDWFVREVSGGSGGSGGSDLCVLEELFWGASLFSYCSG | 13.2 | 11.7 | 0.4 | 27.6 | 0.0 |
| B11 | SHENFYDWFVR.GPGGSGGSGGSHLCVLEELFWGDSLFGACPG | 10.9 | 9.1 | 0.3 | 27.0 | 0.0 |
| A9 | FHENFYDWFARQVSGGSGGSGGSHLCVLEELFWGASLFA.CSD | 10.7 | 12.3 | 0.5 | 25.7 | 0.0 |
| A6 | FPDNFYDWFVR.VSGGSGGSGGSHLCVLEELFWGASPFGYCSG | 11.6 | 8.7 | 0.4 | 19.8 | 0.1 |
| A4 | FQENFYDWFGRQISGGSGGSGGSPLCDVEELFWGVSLFGYCTG | 13.6 | 12.1 | 2.6 | 4.6 | 0.2 |
| C8 | FQENFYDWFVR.ASGGSGGSGGSHLCALEEQFWGSSQFRYCSG | 16.0 | 14.5 | 3.2 | 4.5 | 0.2 |
| A10 | FHENFYDWFARQVRQVAGGSGGSGGSHLCVLEELF.GASLFATCSD | 10.6 | 6.0 | 1.5 | 3.9 | 0.3 |
| D11 | FHENFYDRIVRQVAGGSGGSGGSGGSALCVREELF.GDSLFGDCSG | 12.4 | 5.5 | 1.5 | 3.6 | 0.3 |
| D4 | FHKNFYDWFDRQVSGGSGGSGGSSRLCDLEELFWGASL.GHCSG | 15.4 | 9.8 | 3.9 | 2.5 | 0.4 |
| C1 | FHENFYDWFIRQDSGGSGGSGGSGGSHLCAFEELLGGASPFGYCSG | 16.8 | 2.7 | 1.3 | 2.1 | 0.5 |
| D12 | | 11.7 | 8.7 | 4.6 | 1.9 | 0.5 |
| D8 | SNENFYDWFDR.VSGGSGGSGGSHLCLLEELSWGASLFGCYG | 15.8 | 9.6 | 7.4 | 1.3 | 0.8 |
| C11 | FHESFYDWFDRQVSGGSGGSGGSGGSHLCVLEE.ELGASVFGCCSG | 11.0 | 5.8 | 5.4 | 1.1 | 0.9 |
| C4 | FHETFYDWFDR.VSGGSGGSGEELFGGASLFGYPSG | 16.7 | 13.2 | 15.0 | 0.9 | 1.1 |
| D1 | SHENFYDWFGRQVSGGSGGSGGSNLCDLDEVS.GASLCGYRSG | 16.2 | 5.5 | 7.1 | 0.8 | 1.3 |
| C6 | FH.NFYDWFFCQVPEWIPMTLAVLTCAVLEEPIWGDSLFGYG.E | 16.1 | 1.7 | 2.2 | 0.8 | 1.3 |
| A5 | SHENFYDWFVRQV.GSSGGSGGSHLCDLEELLGGASLMGSCSG | 16.0 | 8.7 | 12.9 | 0.7 | 1.5 |
| B8 | SHENFYDWFVR.VSGGAAAGAGAPPAMASHENFYDWFVR.VSGG | 15.2 | 8.9 | 13.9 | 0.6 | 1.6 |
| D2 | FHENFYDWFIR.VGGGSGGSGGSDLCVLEDDCSRAAAGAP | 13.9 | 8.4 | 13.1 | 0.6 | 1.6 |
| A2 | DYKDASVSGTEHDAFYEWFWR.VGS | 13.4 | 6.9 | 12.6 | 0.6 | 1.8 |
| C12 | FHENFYDLVPSAGSWWIRWLWRF.PVRLGRTVLGCFSDR.LFW | 9.2 | 4.4 | 6.8 | 0.6 | 1.5 |
| B9 | FHENFYDWFDRQVSGGSGGSGGSVRAAAGAP | 17.8 | 8.2 | 16.3 | 0.5 | 2.0 |
| B1 | VHENFYDWFDRQVSGGSGGSGGSGGSQLCDL.EVIWGASLFGYCTG | 18.1 | 7.3 | 13.4 | 0.5 | 1.8 |

FIG. 44A-1

| Clone | Sequence | E-Tag | IR | IGFR | IR/IGFR | IGFR/IR |
|---|---|---|---|---|---|---|
| B2 | FHENFYDWFDR.VSGGSGGGSSHLCVPEEQFWGASRFGYCSA | 16.2 | 7.0 | 13.6 | 0.5 | 1.9 |
| D9 | FHDNFYDWFVRQVSGGSGGGSRQCGASL.GYCSG | 17.0 | 6.6 | 13.8 | 0.5 | 2.1 |
| D5 | OUT OF FRAME | 16.1 | 4.8 | 10.5 | 0.5 | 2.2 |
| C9 | FHEDFYDWFVR.VPGGSGGGSSHLCVPGYCSS | 17.2 | 5.1 | 14.2 | 0.4 | 2.8 |
| B7 | FRENFYDWFVC.VSGGSGGGSNLCVLEEAAAGAP | 15.9 | 4.0 | 10.6 | 0.4 | 2.7 |
| D6 | OUT OF FRAME | 15.6 | 4.2 | 12.8 | 0.3 | 3.0 |
| C5 | GHDNFYDWFVRQVSGGSGGGSSHLCV.GAFPWGYCSD | 15.2 | 3.6 | 10.7 | 0.3 | 3.0 |
| D3 | FH.NFYDWFVRQVYGGSGGGSGTGAAAGAP | 16.2 | 3.5 | 12.0 | 0.3 | 3.4 |
| C10 | BAD SEQUENCE | 11.2 | 2.5 | 7.6 | 0.3 | 3.1 |
| A7 | FHENFYDWFGRQVYGGSGGGSSGSPVCILGELS.GGALFGDCSG | 15.5 | 1.8 | 5.1 | 0.3 | 2.9 |
| A12 | FHENFYDWFVR.LSGGSGGGSSHLCVPEERLWGDPLFGYCSG | 8.7 | 1.2 | 3.5 | 0.3 | 3.0 |
| D7 | FH.NFYDWFVRQVSGGSGGGSSGGSHPAR | 16.2 | 3.0 | 11.9 | 0.2 | 4.0 |
| A11 | FHENFYDWFVRQVTGGSGGGSSGGSSGGSHLCVLEELS.GAALPGYCSG | 11.8 | 1.0 | 4.0 | 0.2 | 4.1 |
| D10 | VQGSFYDWFVRQVSGGSGGGSSGGSSGGSHLC.GSG | 12.7 | 1.0 | 6.3 | 0.2 | 6.6 |
| C3 | FHENFYEWFVRQVSGGSGGGSSGGSHRCDVEELH.CASG | 16.8 | 0.6 | 2.5 | 0.2 | 4.2 |
| A1 | DYKDGGYWGSFYEGLM.LVQSGTSG | 13.6 | 1.7 | 12.5 | 0.1 | 7.1 |
| B6 | OUT OF FRAME | 12.7 | 1.0 | 8.1 | 0.1 | 8.1 |

Non-Binders:

| Clone | Sequence | E-Tag | IR | IGFR | IR/IGFR | IGFR/IR |
|---|---|---|---|---|---|---|
| B12 | FHENFYDWFDRQVSGGSGGGSSHRCVLEERFWGASLFG.CSG | 7.8 | 0.5 | 1.6 | 0.3 | 3.3 |
| B10 | SHENFYDWFVHQVSGGSGGGSSHLCVLEERF.GPSLFGYCSG | 10.8 | 0.6 | 1.4 | 0.4 | 2.3 |
| B3 | FHANFYDWFFRQVSGGSGGGSSGGSDLCVLQDMF.GGSGAAAGAP | 16.9 | 0.7 | 1.2 | 0.6 | 1.7 |
| C2 | FQDNFYDWFVRQISGGSGGGSSGGSSHLCVLESWF.GASLFGYCSG | 14.8 | 0.5 | 0.8 | 0.6 | 1.7 |

FIG. 44A-2

IGFR

| Clone | Sequence | E-Tag | IR | IGFR | IR/IGFR | IGFR/IR |
|---|---|---|---|---|---|---|
| H11 | FHETFYD.LGRLVFGGSGGGSGGSHLCVPEELFWGTSLLSYCSG | 9.3 | 0.4 | 4.0 | 0.1 | 11.4 |
| F11 | FHENFYDWFVRQVSGGSGGSGGSGGSHL.GSG | 12.5 | 0.8 | 5.2 | 0.2 | 6.5 |
| E2 | FHENFYDWFVRQVSGGSGGSGGSHRCGLEEPV.GASLVGYCAG | 13.4 | 1.3 | 7.5 | 0.2 | 5.7 |
| G7 | FHANFYDWFVRQV.GGSGGSGGSG | 16.1 | 2.1 | 9.8 | 0.2 | 4.7 |
| G12 | FHEDFYDWFVRQVGGGSGGSGGSHLCVREELF.GASLLGDCSG | 9.4 | 1.2 | 5.5 | 0.2 | 4.6 |
| H7 | .HENFYDMFVRQLSGGSGGSDGSHLFGYGSG | 7.2 | 0.6 | 2.7 | 0.2 | 4.5 |
| G11 | OUT OF FRAME | 11.4 | 1.4 | 5.8 | 0.2 | 4.3 |
| F7 | FHENFYDWFDRQVGGGSGGSGGFSPVRTGRTVLGGFSVRLLLW | 15.0 | 2.7 | 10.9 | 0.2 | 4.1 |
| G1 | SHDNFYDWFVR.VSGGSGGSGGSPLCVLGNCSG | 11.3 | 2.8 | 10.6 | 0.3 | 3.8 |
| E8 | FYDNFYHWFDR.VSGGSGGSGGSHLCVLEERVCGASLFDYRSG | 13.5 | 0.9 | 3.4 | 0.3 | 3.7 |
| E9 | FSEHFYDWFARQVSGGSGGSGGSHLCVLDERF.GASMVGYCSG | 14.5 | 0.7 | 2.3 | 0.3 | 3.6 |
| G2 | FPENFYDWFDRQVSGGSGGSGGGASLFG.GSG | 15.3 | 3.8 | 13.1 | 0.3 | 3.5 |
| E3 | FHENFYDWFDRQVSGGSGGSGGSHQCVQEERFWGASLCGYCSG | 15.9 | 1.9 | 6.7 | 0.3 | 3.5 |
| E12 | FHDSFYDWFVRQVSGGSGGSGGSHLCGLEELF.GASRFGDCSG | 10.0 | 2.3 | 6.8 | 0.3 | 2.9 |
| E5 | OUT OF FRAME | 14.7 | 3.7 | 9.6 | 0.4 | 2.6 |
| F8 | FHGDFYDWFVR.VSGGSGGSGGSHLCVLEELYCSG | 13.7 | 3.6 | 9.5 | 0.4 | 2.6 |
| E6 | FHDNFYDWFVR.VSGGSGGSGGSHLCVVEERFWGGSPIGYCSG | 13.3 | 3.0 | 7.3 | 0.4 | 2.5 |
| G8 | OUT OF FRAME | 13.9 | 4.5 | 10.5 | 0.4 | 2.4 |
| E1 | FQDNFYDWFVRQVSGGSGGSGGSHRCVLEGCSG | 13.4 | 5.8 | 13.3 | 0.4 | 2.3 |
| H12 | FHENFYDWFDRQVSGGSGGSACLFGYCSG | 9.8 | 3.9 | 8.5 | 0.5 | 2.2 |
| F2 | YHENFYDWFVR.VSGGSG | 14.4 | 6.2 | 12.8 | 0.5 | 2.1 |
| H6 | VHESFYDWFVR.VAGGSGGSGGSGGSHLCDVDCSG | 11.5 | 4.8 | 9.6 | 0.5 | 2.0 |
| H4 | FHDNFYDWFDRQVSGGSGGSGGSPFG.RSD | 11.2 | 5.3 | 10.0 | 0.5 | 1.9 |
| H5 | FH.HFYDWFDRQVSGGSGGSGGSLLCVGEEPFWGASLFAYCSG | 11.8 | 4.4 | 8.5 | 0.5 | 1.9 |
| E7 | FHENFYDWFVRQVSGGSGGSGG | 15.4 | 7.8 | 14.0 | 0.6 | 1.8 |
| F5 | FHESFYDWFVR.VPGGSGGSGGSQLCVQEELFEGDSLLGDCSG | 16.8 | 7.3 | 12.9 | 0.6 | 1.8 |
| F10 | | 13.9 | 5.9 | 10.8 | 0.5 | 1.8 |
| E10 | FHENFYEWFDRQVSGGSGGGVLDERF.GACPSGYCSG | 10.6 | 5.1 | 8.9 | 0.6 | 1.8 |

FIG. 44B-1

| Clone | sequence | E-Tag | IR | IGFR | IR/IGFR | IGFR/IR |
|---|---|---|---|---|---|---|
| F4 | FHDNFYDWFVR.VAGGSGGSGGGSHLCVPEELFWGASLFGYCSG | 15.7 | 3.1 | 5.6 | 0.6 | 1.8 |
| H2 | FGEDFYDWFVR.VSGGSGGSGGGSGGSHLCVLDELFWDASPFGFCPG | 11.4 | 2.5 | 4.6 | 0.6 | 1.8 |
| E11 | .HDNFYGWFDRQVSGGSGGSGGGSGGSHLCVLDELLWGASLFGYCS | 11.7 | 1.3 | 2.2 | 0.6 | 1.7 |
| F12 | FQENFYDWFVR.VSGDELSGGASQCGSCSG | 10.6 | 7.0 | 9.6 | 0.7 | 1.4 |
| F9 | SHESFYDWFVRQVSGGSGGSGGSGSDLCVWEELCGGAPLVG.GSS | 16.0 | 9.9 | 13.3 | 0.7 | 1.3 |
| E4 | FPENFYDWFDRQVSGGSGGSGGGSSG | 16.4 | 13.4 | 15.8 | 0.8 | 1.2 |
| H10 | FRENFYDWFERQVSGGSGGSGGGSGGSHLCVLEELSWGASTFGSCSG | 10.8 | 7.8 | 9.1 | 0.8 | 1.2 |
| F3 | IHVDFYDWFAR.VSGGSGGSGGGSGGSSLCVLDELFWDASLFGDCAG | 14.2 | 3.9 | 4.6 | 0.8 | 1.2 |
| G6 | FHASFYDWFDRQVSGGSGGSGGGSGGSHLCDLEGLFWGAAPFGYCSG | 16.2 | 11.0 | 12.1 | 0.9 | 1.1 |
| H3 | SDANFYDWFLR.VSGGSGGSGGGSGGSHLCALEEQFWDASLFGDCSG | 13.1 | 9.8 | 11.1 | 0.9 | 1.1 |
| G5 | FHDKFYDWFVS.VAGGSGGSGGGSGGSHLCVLEDRFWGSSLSGYCSG | 14.7 | 7.1 | 7.9 | 0.9 | 1.1 |
| H9 | FHDNFYDWFVRQVTDGSGGSGGGSGGSQLCVVEDLFWDASRFGYC.G | 13.1 | 8.2 | 8.0 | 1.0 | 1.1 |
| G3 | VSEDFYEWFVR.ASGGSGGSGGGSGGSNLCVLEELFWGSSLIGDCSG | 13.7 | 11.7 | 2.5 | 4.6 | 0.2 |
| G4 | FPENFYDWFVRQVSGGSGGSGGGSGGSHLCVLEEL.NGASMFGYCSG | 10.0 | 4.3 | 0.7 | 6.0 | 0.2 |
| F6 | FQENFYDWFVRQVSGGSGGSGGGSGGSHLCVLEALFWGASLFG.CSG | 5.6 | 9.0 | 0.4 | 21.2 | 0.0 |

Non-Binders:

| | | | | | | |
|---|---|---|---|---|---|---|
| H1 | DYKDGRGGRRF.GRSSVVLWKRL.R | 1.2 | 0.7 | 0.5 | 1.5 | 0.7 |
| G10 | DTKTFIGITGVLPRLSAV.GFWGGSW | 1.7 | 0.3 | 0.3 | 0.8 | 1.2 |
| G9 | CHENFYVWFVSQVAGGSGGSGGGSGGSRLCIM.ELFRGASLFGYSSG | 2.0 | 0.4 | 0.5 | 0.9 | 1.1 |
| F1 | FHANFYDWFVR.VSGGSGGSGGGSHLCVLEELVSGPSLLGYCSG | 14.5 | 0.6 | 1.5 | 0.4 | 2.3 |
| H8 | FHEKFYDWFDL.LSGGSGGSGGGSGGSHLCVREEPFWGASLFGYCPG | 9.7 | 0.6 | 1.5 | 0.4 | 2.3 |

FIG. 44B-2

IGFR Binders with change in Cys

| Clone | Sequence | E-Tag | IR | IGFR | IR/IGFR | IGFR/IR |
|---|---|---|---|---|---|---|
| F8 (X14) | HLCVLEELFWGASLFGYCSG | 11.3 | 2.8 | 10.6 | 0.3 | 3.8 |
| D8 (X6) | WLDQEWAWVQCEVYGRGCPS | 13.5 | 0.9 | 3.4 | 0.3 | 3.7 |
| G1 (X4) | SHDNFYDWFVR.VSGGSGGSGGSPLCVLGNCSG | 15.9 | 1.9 | 6.7 | 0.3 | 3.5 |
| E8 (X6) | FYDNFYHWFDR.VSGGSGGSGGSHLCVLEERVCGASLFDYRSG | 13.7 | 3.6 | 9.5 | 0.4 | 2.6 |
| E3 (X10) | FHENFYDWFDRQVSGGSGGSGGSHQCVQERFWGASLCGYCSG | 13.4 | 5.8 | 13.3 | 0.4 | 2.3 |
| F8 (X6) | FHGDFYDWFVR.VSGGSGGSGGSHLCVLEELYCSG | 9.8 | 3.9 | 8.5 | 0.5 | 2.2 |
| E1 (X4) | FQDNFYDWFVRQVSGGSGGSGGSHRCVLEGCSG | 11.5 | 4.8 | 9.6 | 0.5 | 2.0 |
| H12 (X4) | FHENFYDWFDRQVSGGSGGSACLFGYCSG | 10.6 | 5.1 | 8.9 | 0.6 | 1.8 |
| H6 (X3) | VHESFYDWFVR.VAGGSGGSGGSHLCDVDCSG | 10.6 | 7.0 | 9.6 | 0.7 | 1.4 |
| E10 (X4) | FHENFYEWFDRQVSGGSGGGVLDERF.GACPSGYCSG | 16.0 | 9.9 | 13.3 | 0.7 | 1.3 |
| F12 (X2) | FQENFYDWFVR.VSGDELSGGASQCGSCSG | | | | | |
| F9 (X5) | SHESFYDWFVRQVSGGSGGSGGSDLCVWEELCGGAPLVG.GSS | | | | | |

IGFR Binders with loss of F8

| | | E-Tag | IR | IGFR | IR/IGFR | IGFR/IR |
|---|---|---|---|---|---|---|
| G7 | FHANFYDWFVRQV.GGSGGSGGSG | 16.1 | 2.1 | 9.8 | 0.2 | 4.7 |
| F2 | YHENFYDWFVR.VSGGSG | 14.4 | 6.2 | 12.8 | 0.5 | 2.1 |
| E7 | FHENFYDWFVRQVSGGSGGSGGSGG | 15.4 | 7.8 | 14.0 | 0.6 | 1.8 |
| E4 | FPENFYDWFDRQVSGGSGGSGGSSG | 16.4 | 13.4 | 15.8 | 0.8 | 1.2 |

IGFR Binders with loss of Cys in F8

| | | E-Tag | IR | IGFR | IR/IGFR | IGFR/IR |
|---|---|---|---|---|---|---|
| F11 | FHENFYDWFVRQVSGGSGGSGGSHL.GSG | 12.5 | 0.8 | 5.2 | 0.2 | 6.5 |
| H7 | .HENFYDWFVRQLSGGSGGSDGSHLFGYGSG | 7.2 | 0.6 | 2.7 | 0.2 | 4.5 |
| F7 | FHENFYDWFDRQVGGGSGGSGGFSPVRTGRTVLGGFSVRLLLW | 15.0 | 2.7 | 10.9 | 0.2 | 4.1 |
| G2 | FPENFYDWFDRQVSGGSGGGASLFG.GSG | 15.3 | 3.8 | 13.1 | 0.3 | 3.5 |
| H4 | FHDNFYDWFDRQVSGGSGGSGGSPFG.RSD | 11.2 | 5.3 | 10.0 | 0.5 | 1.9 |

FIG. 44B-3

INSULIN AND IGF-1 RECEPTOR AGONISTS AND ANTAGONISTS

This application is a continuation-in-part of U.S. application Ser. No. 09/538,038 filed Mar. 29, 2000, which is a continuation-in-part of U.S. application Ser. No. 09/146,127, filed Sep. 2, 1998 now abandoned, both of which are incorporated by reference in their entirety.

I. FIELD OF THE INVENTION

This invention relates to the field of hormone receptor activation or inhibition. More specifically, this invention relates to the identification of molecular structures, especially peptides, which are capable of acting at either the insulin or insulin-like growth factor receptors as agonists or antagonists. Also related to this invention is the field of molecular modeling whereby useful molecular models are derived from known structures.

II. BACKGROUND OF THE INVENTION

Insulin is a potent metabolic and growth promoting hormone that acts on cells to stimulate glucose, protein, and lipid metabolism, as well as RNA and DNA synthesis. A well-known effect of insulin is the regulation of glucose levels in the body. This effect occurs predominantly in liver, fat, and muscle tissue. In the liver, insulin stimulates glucose incorporation into glycogen and inhibits the production of glucose. In muscle and fat tissue, insulin stimulates glucose uptake, storage, and metabolism. Defects in glucose utilization are very common in the population, giving rise to diabetes.

Insulin initiates signal transduction in target cells by binding to a specific cell-surface receptor, the insulin receptor (IR). The binding leads to conformational changes in the extracellular domain of IR, which are transmitted across the cell membrane and result in activation of the receptor's tyrosine kinase activity. This, in turn, leads to autophosphorylation of tyrosine kinase of IR, and the binding of soluble effector molecules that contain SH2 domains such as phophoinositol-3-kinase, Ras GTPase-activating protein, and phospholipase Cy to IR (Lee and Pilch, 1994, Am. J. Physiol. 266:C319–C334).

Insulin-like growth factor 1 (IGF-1) is a small, single-chain protein (MW=7,500 Da) that is involved in many aspects of tissue growth and repair. Recently, IGF-1 has been implicated in various forms cancer including prostate, breast, colorectal, and ovarian cancers. It is similar in size, sequence, and structure to insulin, but has 100–1,000-fold lower affinity for IR (Mynarcik et al., 1997, J. Biol. Chem. 272:18650–18655).

Clinically, recombinant human IGF-1 has been investigated for the treatment of several diseases, including type I diabetes (Carroll et at., 1997, Diabetes 46:1453–1458; Crowne et al., 1998, Metabolism 47:31–38), amyotropic lateral sclerosis (La! et al, 1997, Neurology 49:1621–1630), and diabetic motor neuropathy (Apfel and Kessler, 1996, CIBA Found. Symp. 196:98–108). Other potential therapeutic applications of IGF-1, such as osteoporosis (Canalis, 1997, Bone 21:215–216), immune modulation (Clark, 1997, Endocr. Rev. 18:157–179) and nephrotic syndrome (Feld and Hirshberg, 1996, Pediatr. Nephrol. 10:355–358), are also under investigation.

A number of studies have analyzed the role of endogenous IGF-1 in various disease states. Interestingly, several reports have shown that IGF-1 promotes the growth of normal and cancerous prostate cells both in vitro and in vivo (Angelloz-Nicoud and Binoux, 1995, Endocdnol. 136:5485–5492; Figueroa et at., 1995, J. Clin. Endocfinol. Metab. 80:3476–3482; Torring et al., 1997, J. Urol. 158:222–227). Additionally, elevated serum IGF-1 levels correlate with increased risks of prostate cancer, and may be an earlier predictor of cancer than is prostate-specific antigen (PSA) (Chan et al., 1998, Science 279:563–566). Recent studies have indicated a connection between IGF-1 levels and other cancers such as breast, colorectal, and ovarian. Serum IGF-1 levels are regulated by the presence of IGF binding proteins (IGFBP) which bind to IGF-1 and prevent its interaction with the IGF-1 receptor (IGF-1R; reviewed in Conover, 1996, Endocr. J. 43S:S43-S48 and Rajaram etal., 1997, Endocr. Rev. 18:801831). Interestingly, PSA has been shown to be a protease that cleaves IGFBP-3, resulting in an increase of free IGF-1 in serum (Cohen et al., 1992, J. Clin. Endocrinol. Metab. 75:1046–1053; Cohen et a!., 1994, J. Endocrinol. 142:407415; Lilja, 1995, J. Clin. Lab. Invest. Suppl. 220:47–56). Clearly, regulation of IGF-1R activity can play an important role in several disease states, indicating that there are potential clinical applications for both IGF-1 agonists and antagonists.

IGF-1R and IR are related members of the tyrosine-kinase receptor superfamily of growth factor receptors. Both types of receptors are composed of two $\alpha$ and two $\beta$ subunits which form a disulfide-linked heterotetramer ($\beta$-$\alpha$-$\alpha$-$\beta$). These receptors have an extracellular ligand binding domain, a single transmembrane domain, and a cytoplasmic domain displaying the tyrosine kinase activity. The extracellular domain is composed of the entire a subunits and a portion of the N-terminus of the $\beta$ subunits, while the intracellular portion of the $\beta$ subunits contains the tyrosine kinase domain. Another family member is insulin-related receptor (IRR), for which no natural ligand is known.

While similar in structure, IGF-1R and IR serve different physiological functions. IR is primarily involved in metabolic functions whereas IGF-1R mediates growth and differentiation. However, both insulin and IGF-1 can induce both mitogenic and metabolic effects. Whether each ligand elicits both activities via its own receptor, or whether insulin exerts its mitogenic effects through its weak affinity binding to IGF-1R, and IGF-1 its metabolic effects through IR, remains controversial (De Meyts, 1994, Horm. Res. 42:152–169).

IR is a glycoprotein having molecular weight of 350–400 kDa (depending on the level of glycosylation). It is synthesized as a single polypeptide chain and proteolytically cleaved to yield a disulfide-linked monomer $\alpha$-$\beta$ insulin receptor. Two $\alpha$-$\beta$ monomers are linked by disulfide bonds between the $\alpha$-subunits to form a dimeric form of the receptor ($\beta$-$\alpha$-$\alpha$-$\beta$-type configuration). The a subunit is comprised of 723 amino acids, and it can be divided into two large homologous domains, L1 (amino acids 1–155) and L2 (amino acids 313468), separated by a cysteine rich region (amino acids 156–312) (Ward et al., 1995, Prot. Struct. Funct. Genet. 22:141–153). Many determinants of insulin binding seem to reside in the $\alpha$-subunit. A unique feature of IR is that it is dimeric in the absence of ligand.

The sequence of IR is highly homologous to the sequence of IGF-1R. The sequence identity level varies from about 40% to 70%, depending on the position within the $\alpha$-subunit. The three-dimensional structures of both receptors may therefore be similar. The crystal structure of the first three domains of IGF-1R has been determined (Garrett et al, 1998, Nature 394:395–399). The L domains consist of a single-stranded right-handed $\beta$-helix (a helical arrangement of $\beta$-strands), while the cysteine-rich region is composed of eight disulfide-bonded modules.

The β-subunit of the insulin receptor has 620 amino acid residues and three domains: extracellular, transmembrane, and cytosolic. The extracellular domain is linked by disulfide bridges to the α-subunit. The cytosolic domain includes the tyrosine kinase domain, the three-dimensional structure of which has been solved (Hubbard et al., 1994, Nature 372:746–754).

To aid in drug discovery efforts, a soluble form of a membrane-bound receptor was constructed by replacing the transmembrane domain and the intracellular domain of IR with constant domains from immunoglobulin Fc or λ subunits (Bass et at., 1996, J. Biol. Chem. 271:19367–19375). The recombinant gene was expressed in human embryonic kidney 293 cells. The expressed protein was a fully processed heterotetramer and the ability to bind insulin was similar to that of the full-length holoreceptor.

IGF-1 and insulin competitively cross-react with IGF-R and IR. (L. Schäffer, 1994, Eur. J. Biochem. 221:1127–1132). Despite 45% overall amino acid identity, insulin and IGF-1 bind only weakly to each other's receptor. The affinity of each peptide for the non-cognate receptor is about 3 orders of magnitude lower than that for the cognate receptor (Mynarcik, et al., 1997, J. Biol. Chem. 272:18650–18655). The differences in binding affinities may be partly explained by the differences in amino acids and unique domains which contribute to unique tertiary structures of ligands (Blakesley et al., 1996, Cytokine Growth Factor Rev. 7(2):153–9).

Both insulin and IGF-1 are expressed as precursor proteins comprising, among other regions, contiguous A, B, and C peptide regions, with the C peptide being an intervening peptide connecting the A and B peptides. A mature insulin molecule is composed of the A and B chains connected by disulfide bonds, where the connecting C peptide has been removed during post-translational processing. IGF-1 retains its smaller C-peptide as well as a small D extension at the C-terminal end of the A chain, making the mature IGF-1 slightly larger than insulin (Blakesley, 1996). The C region of human IGF-1 appears to be required for high affinity binding to IGF-R (Pietrzkowski et al., 1992, Cancer Res. 52(23):6447–51). Specifically, tyrosine 31 located within this region appears to be essential for high affinity binding. Furthermore, deletion of the D domain of IGF-1 increased the affinity of the mutant IGF-1 for binding to the IR, while decreasing its affinity for the IGF-1R (Pietrzkowski et al., 1992). A further distinction between the two hormones is that, unlike insulin, IGF-1 has very weak self-association and does not hexamerize (De Meyts, 1994).

The α-subunits, which contain the ligand binding region of IR and IGF-1R, demonstrate between 47–67% overall amino acid identity. Three general domains have been reported for both receptors from sequence analysis of the α subunits, L1-Cys-rich-L2. The cysteine residues in the C-rich region are highly conserved between the two receptors; however, the cysteine-rich domains have only 48% overall amino acid identity.

Despite the similarities observed between these two receptors, the role of the domains in specific ligand binding are distinct. Through chimeric receptor studies, (domain swapping of the IR and IGF-R α-subunits), researchers have reported that the sites of interaction of the ligands with their specific receptors differ (T. Kjeldsen et al., 1991, Proc. Natl. Acad. Sci. USA 88:44044408; A. S. Andersen et al., 1992, J. Biol. Chem. 267:13681–13686). For example, the cysteine-rich domain of the IGF-1R was determined to be essential for high-affinity IGF binding, but not insulin binding. When amino acids 191–290 of IGF-1R region was introduced into the corresponding region of the IR (amino acids 198–300), the modified IR bound both IGF-1 and insulin with high affinity. Conversely, when the corresponding region of the IR was introduced into the IGF-1R, the modified IGF-R bound to IR but not IGF-1.

A further distinction between the binding regions of the IR and IGF-1R is their differing dependence on the N-terminal and C-terminal regions. Both the N-terminal and C-terminal regions (located within the putative L1 and L2 domains) of the IR are important for high-affinity insulin binding but appear to have little effect on IGF-1 binding for either IR or IGF-1R. Replacing residues in the N-terminus of IGF-1R (amino acids 1–62) with the corresponding residues of IR (amino acids 1–68) confers insulin-binding ability on IGF-1R. Within this region, residues Phe-39, Arg41 and Pro-42 are reported as major contributors to the interaction with insulin (Williams et al., 1995). When these residues are introduced into the equivalent site of IGF-1R, the affinity for insulin is markedly increased, whereas, substitution of these residues by alanine in IR results in markedly decreased insulin affinity. Similarly, the region between amino acids 704–717 of the C-terminus of IR has been shown to play a major role in insulin specificity. Substitution of these residues with alanine also disrupts insulin binding (Mynarcik et al., 1996, J. Biol. Chem. 271(5):243942; C. Kristensen et al, 1'999, J. Biol. Chem. 274(52):37351–37356).

Further studies of alanine scanning of the receptors suggest that insulin and IGF-1 may use some common contacts to bind to IGF-1R but that those contacts differ from those that insulin utilizes to bind to IR (Mynarcik et al., 1997). Hence, the data in the literature has led one commentator to state that even though "the binding interfaces for insulin and IGF-1 on their respective receptors may be homologous within this interface the side chains which make actual contact and determine specificity may be quite different between the two ligand-receptor systems" (De Meyts, 1994).

Based on data for binding of insulin and insulin analogs to various insulin receptor constructs, a binding model has been proposed. This model shows insulin receptor with two insulin binding sites that are positioned on two different surfaces of the receptor molecule, such that each alpha-subunit is involved in insulin binding. In this way, activation of the insulin receptor is believed to involve cross-connection of the alpha-subunits by insulin. A similar mechanism may operate for IGF-1R, but one of the receptor binding interactions appears to be different (Schäffer, 1994, Eur. J. Biochem. 221:1127–1132).

The identification of molecular structures having a high degree of specificity for one or the other receptor is important to developing efficacious and safe therapeutics. For example, a molecule developed as an insulin agonist should have little or no IGF-1 activity in order to avoid the mitogenic activity of IGF-1 and a potential for facilitating neoplastic growth. It is therefore important to determine whether insulin and IGF-1 share common three-dimensional structures but which have sufficient differences to confer selectivity for their respective receptors. Similarly, it would be desirable to identify other molecular structures that mimic the active binding regions of insulin and/or IGF-1 and which impart selective agonist or antagonist activity.

Although certain proteins are important drugs, their use as therapeutics presents several difficult problems, including the high cost of production and formulation, administration usually via injection and limited stability in the bloodstream.

Therefore, replacing proteins, including insulin or IGF-1, with small molecular weight drugs has received much attention. However, to date, none of these efforts has resulted in finding an effective drug replacement.

Peptides mimicking functions of protein hormones have been previously reported. Yanofsky et al., (1996, Proc. Natl. Acad. Sci. USA 93:7381–7386) reported the isolation of a monomer antagonistic to IL-1 with nanomolar affinity for the IL-1 receptor. This effort required construction and use of many phage displayed peptide libraries and sophisticated phage-panning procedures.

Wrighton et al. (1996, Science 273:458464) and Livnah et al. (1996, Science 273:464471) reported dimer peptides that bind to the erythropoietin (EPO) receptor with full agonistic activity in vivo. These peptides are cyclical and have intra-peptide disulfide bonds; like the IL-1 receptor antagonist, they show no significant sequence identity to the natural ligand. Importantly, X-ray crystallography revealed that it was the spontaneous formation of non-covalent peptide homodimer peptides that enabled the dimerization two EPO receptors.

WO 96/04557 reported the identification of peptides and antibodies that bound to active sites of biological targets, which were subsequently used in competition assays to identify small molecules that acted as agonist or antagonists at the biological targets. Renchler et al. (1994, Proc. Natl. Acad. Sci. USA 91:3623–3627) reported synthetic peptide ligands of the antigen binding receptor that induced programmed cell death in human B-cell lymphoma.

Most recently, Cwirla et al. (1997, Science 276:1696–1698) reported the identification of two families of peptides that bound to the human thrombopoietin (TPO) receptor and were competed by the binding of the natural TPO ligand. The peptide with the highest affinity, when dimerized by chemical means proved to be as potent an in vivo agonist as TPO, the natural ligand.

III. SUMMARY OF THE INVENTION

This invention relates to the identification of amino acid sequences that specifically recognize sites involved in IR or IGF-1R activation. Specific amino acid sequences are identified and their agonist or antagonist activity at IR and/or IGF-LR has been determined. Such sequences may be developed as potential therapeutics or as lead compounds to develop other more efficacious ones. In addition, these sequences may be used in high-throughput screens to identify and provide information on small molecules that bind at these sites and mimic or antagonize the functions of insulin or IGF-1. Furthermore, the peptide sequences provided by this invention can be used to design secondary peptide libraries, which can be used to identify sequence variants that increase or modulate the binding and/or activity of the original peptide at IR or IGF-1R.

In one aspect of this invention, large numbers of peptides have been screened for their IR and IGF-1R binding and activity characteristics. Analysis of their amino acid sequences has identified certain consensus sequences which may be used themselves or as core sequences in larger amino acid sequences conferring upon them agonist or antagonist activity. Several generic amino acid sequences are disclosed which bind IR and/or IGF-R with varying degrees of agonist or antagonist activity depending on the specific sequence of the various peptides identified within each motif group. Also provided are amino or carboxyl terminal extensions capable of modifying the affinity and/or pharmacological activity of the consensus sequences when part of a larger amino acid sequence.

The amino acid sequences of this invention which bind IR and/or IGF-1R include:

a. $X_1 X_2 X_3 X_4 X_5$ wherein $X_1$, $X_2$, $X_4$ and $X_5$ are aromatic amino acids, and $X_3$ is any polar amino acid (Formula 1; Group 1; A6 motif);

b. $X_6 X_7 X_8 X_9 X_{10} X_{11} X_{12} X_{13}$ wherein $X_6$ and $X_7$ are aromatic amino acids, $X_8$, $X_9$, $X_{11}$ and $X_{12}$ are any amino acid, and $X_{10}$ and $X_{13}$ are hydrophobic amino acids (Formula 2; Group 3; B6 motif);

c. $X_{14} X_{15} X_{16} X_{17} X_{18} X_{19} X_{20} X_{21}$ wherein $X_{14}$, and $X_{17}$ are hydrophobic amino acids, $X_{15}$, $X_{16}$ $X_{18}$ and $X_{19}$ are any amino acid, and $X_{20}$ and $X_{21}$ are aromatic amino acids (Formula 3; reverse B6; revB6).

d. $X_{22} X_{23} X_{24} X_{25} X_{26} X_{27} X_{28} X_{29} X_{30} X_{31} X_{32} X_{33} X_{34} X_{35} X_{36} X_{37} X_{38} X_{39} X_{40} X_{41}$ wherein $X_{22}$, $X_{25}$, $X_{28}$, $X_{29}$, $X_{30}$, $X_{33}$, $X_{34}$, $X_{35}$, $X_{36}$, $X_{38}$, $X_{40}$, and $X_{41}$ are any amino acid, $X_{35}$ and $X_{37}$ may be any amino acid for binding to IR, whereas $X_{35}$ is preferably a hydrophobic amino acid and $X_{37}$ is preferably glycine for binding to IGF-1R and possess agonist or antagonist activity. $X_{23}$ and $X_{26}$ are hydrophobic amino acids. This sequence further comprises at least two cysteine residues, preferably at $X_{25}$ and $X_{40}$ $X_{31}$ and $X_{32}$ are small amino acids (Formula 4; Group 7; E8 motif).

e. $X_{42} X_{43} X_{44} X_{45} X_{46} X_{47} X_{48} X_{49} X_{50} X_{52} X_{53} X_{54} X_{55} X_{56} X_{57} X_{58} X_{59} X_{60} X_{61}$ wherein $X_{42}$ $X_{43}$ $X_{44}$, $X_{45}$, $X_{53}$, $X_{55}$, $X_{56}$, $X_{58}$, X and $X_{41}$ may be any amino acid, $X_{43}$, $X_{46}$, $X_{49}$, $X_{50}$, $X_{54}$ are hydrophobic amino acids, $X_{47}$ and $X_{59}$ are preferably cysteines, $X_{48}$ is a polar amino acid, and $X_{51}$, $X_{52}$ and $X_{57}$ are small amino acids (Formula 5; mini F8 motif).

f. $X_{62} X_{63} X_{64} X_{65} X_{66} X_{67} X_{68} X_{69} X_{70} X_{71} X_{72} X_{73} X_{74} X_{75} X_{76} X_{77} X_{78} X_{79} X_{80} X_{81}$ wherein $X_{62}$, $X_{65}$, $X_{68}$, $X_{69}$, $X_{71}$, $X_{73}$, $X_{76}$, $X_{77}$, $X_{78}$, $X_{80}$, and $X_{81}$ may be any amino acid; $X_{63}$, $X_{70}$, $X_{74}$ are hydrophobic amino acids; $X_{64}$ is a polar amino acid, $X_{67}$ and $X_{75}$ are aromatic amino acids and $X_{72}$ and $X_{79}$ are preferably cysteines capable of forming a loop (Formula 6; Group 2; D8 motif).

g. H $X_{82} X_{83} X_{84} X_{85} X_{86} X_{87} X_{88} X_{89} X_{90} X_{91} X_{92}$ wherein $X_{82}$ is proline or alanine, $X_{83}$ is a small amino acid, $X_{84}$ is selected from leucine, serine or threonine, $X_{85}$ is a polar amino acid, $X_{86}$ $X_{88}$, $X_{89}$ and $X_{90}$ are any amino acid, and $X_{87}$, $X_{91}$ and $X_{92}$ are an aliphatic amino acid (Formula 7).

h. $X_{104} X_{105} X_{106} X_{107} X_{108} X_{109} X_{110} X_{111} X_{112} X_{113} X_{114}$ wherein at least one of the amino acids of $X_{106}$ through $X_{111}$, and preferably two, are tryptophan separated by three amino acids, and wherein at least one of $X_{104}$, $X_{105}$ and $X_{106}$ and at least one of $X_{112}$, $X_{113}$ and $X_{114}$ are cysteine (Formula 8); and i. an amino acid sequence comprising the sequence JBA5: DYKDLCQSWGVRIGWLAGLCPKK (SEQ ID NO:1541) or JBA5 minus FLAG® tag and terminal lysines: LCQSWGVRIGWLAGLCP (SEQ ID NO:1542) (Formula 9).

j. W $X_{123}$GY $X_{124}$W $X_{125}$ $X_{126}$ (SEQ ID NO:1543) wherein $X_{123}$ is selected from proline, glycine, serine, arginine, alanine or leucine, but more preferably proline; $X_{124}$ is any amino acid, but preferably a charged or aromatic amino acid; $X_{125}$ is a hydrophobic amino acid preferably leucine or phenylalanine, and most preferably leucine. $X_{126}$ is any amino acid, but preferably a small amino acid (Formula 10; Group 6 motif).

In one embodiment, peptides comprising a preferred amino acid sequence FYX$_3$WF (SEQ ID NO: 1544)

(Formula 1; Group 1; A6 motif) have been identified which competitively bind to sites on IR. Surprisingly, peptides comprising an amino acid sequence FYX$_3$WF (SEQ ID NO:1544) can possess agonist or antagonist activity at IR.

This invention also identifies at least two distinct binding sites on IR based on the differing ability of certain of the peptides to compete with one another and insulin for binding to IR. Accordingly, this invention provides amino acid sequences that bind specifically to one or both sites of IR. Furthermore, specific amino acid sequences are provided which have either agonist or antagonist characteristics based on their ability to bind to the specific sites of IR.

In another embodiment of this invention, amino acid sequences which bind to one or more sites of IR or IGF-R (e.g., Site 1 or Site 2) are covalently linked together to form multivalent ligands. These multivalent ligands are capable of forming complexes with a plurality of IR or IGF-1R. Either the same or different amino acid sequences are covalently bound together to form homo- or heterocomplexes.

In various aspects of the invention, monomer subunits are covalently linked at their N-termini or C-termini to form N—N, C—C, N—C, or C—N linked dimer peptides. In one example, dimer peptides are used to form receptor complexes bound through the same corresponding sites, e.g., Site 1-Site 1 or Site 2-Site 2 dimers. Alternatively, heterodimer peptides are used to bind to different sites on one receptor or to cause receptor complexing through different sites, e.g., Site 1-Site 2 or Site 2-Site 1 dimers. In one novel aspect of the invention, Site 2-Site 1 dimers find use as insulin agonists, while certain Site 1-Site 2 dimers find use as insulin antagonists.

In various embodiments, insulin agonists comprise Site 1-Site 1 dimer peptide sequences S325, S332, S333, S335, S337, S353, S374–S376, S378, S379, S381, S414, S415, and S418; whereas other insulin agonists comprise Site 2-Site 1 dimer peptide sequences S455, S457, S458, S467, S468, S471, S499, S510, S518, S519, and S520, as described herein below. In one preferred embodiment, an insulin agonist comprises the sequence of the S519 dimer peptide, which shows insulin-like activity in both in vitro and in vivo assays.

The present invention also provides assays for identifying compounds that mimic the binding characteristics of insulin or IGF-1. Such compounds may act as antagonists or agonists of insulin or IGF-1 function in cell based assays.

This invention further provides kits for identifying compounds that bind to IR and/or IGF-1R. Also provided are therapeutic compounds that bind the insulin receptor or the IGF-1 receptor.

Other embodiments of this invention are the nucleic acid sequences encoding the amino acid sequences of the invention. Also within the scope of this invention are vectors containing the nucleic acids and host cells which express the nucleic acids encoding the amino acid sequences which bind at IR and/or IGF-1R and possess agonist or antagonist activity.

This invention also provides amino acid sequences that bind to active sites of IR and/or IGF-1R and to identify structural criteria for conferring agonist or antagonist activity at IR or IGF-1R.

This invention further provides specific amino acid sequences that possess agonist, partial agonist, or antagonist activity at either IR or IGF-1R. Such amino acid sequences are potentially useful as therapeutics themselves or may be used to identify other molecules, especially small organic molecules, which possess agonist or antagonist activity at IR or IGF-1R.

In addition, the present invention provides structural information derived from the amino acid sequences of this invention, which may be used to construct other molecules possessing the desired activity at the relevant IR binding site.

IV. BRIEF DESCRIPTION OF THE DRAWINGS

FIGS. 1A–1O; 2A–2E; 3A–3E; 4A–4I; 43A–43B, 44A–44B: Amino acid sequences identified by panning peptide libraries against IGF-1R and/or IR. The amino acids are represented by their one-letter abbreviation. The ratios over background are determined by dividing the signal at 405 nm (E-Tag, IGF-R, or 1R) by the signal at 405 nm for non-fat milk. The IGF-1R/IR Ratio Comparison is determined by dividing the ratio of IGF-1R by the ratio of IR. The IR/IGF-1R Ratio Comparison is determined by dividing the ratio of IR by the ratio of IGF-1R. HIT indicates binder; CAND indicates binder candidate; LDH indicates binding to lactate dehydrogenase (negative control); Sp/Irr indicates the ratio of specific binding over non-specific binding.

The design of each library is shown in the first line in bold. In the design, symbol 'X' indicates a random position, an underlined amino acid indicates a doped position at the nucleotide level, and other positions are held constant. Additional abbreviations in the B6H library are: 'O' indicates an NGY codon where Y is C or T; 'J' indicates an RHR codon where R is A or G, and H is A, C, or T; and 'U' indicates an WY codon where V is A, C, or G, and Y is C or T. The 'h' in the 20E2 libraries indicates an NTN codon.

Symbols in the listed sequences are: Q—TAG Stop; #—TAA Stop; *—TGA Stop; and ?—Unknown Amino Acid. It is believed that a W replaces the TGA Stop Codon when expressed. Except for the 20C and A6L libraries, all libraries are designed with the short FLAG® Epitope DYKD (SEQ ID NO:1545; Hopp et al., 1988, Bio/Technology 6:1205–1210) at the N-terminus of the listed sequence and MAGAP (SEQ ID NO:1546) at the C-terminus. The 20C and A6L libraries have the full length FLAG® epitope DYKDDDDK (SEQ ID NO:1547).

FIG. 1A: Formula 1 motif peptide sequences obtained from a random 40mer library panned against IR (SEQ ID NOS:1–3).

FIG. 1B: Formula 1 motif peptide sequence obtained from a random 40mer library panned against IGF-1R (SEQ ID NOS:4–6).

FIG. 1C: Formula 1 motif peptide sequences obtained from a random 20mer library panned against IR (SEQ ID NOS:7–29).

FIG. 1D: Formula 1 motif peptide sequences obtained from a random 20mer library panned against IGF-1R (SEQ ID NOS:30–33).

FIG. 1E: Formula 1 motif peptide sequences obtained from a 21mer library constructed to contain X$_{1-10}$NFYDWFVX$_{18-21}$ (SEQ ID NO:34; also referred to as "A6S") panned against IR (SEQ ID NOS:3598).

FIG. 1F: Formula 1 motif peptide sequences obtained from a 21mer library constructed to contain X$_{1-10}$NFYDWFVX$_{18-21}$ (SEQ ID NO:34; also referred to as "A6S") panned against IGF-1R (SEQ ID NOS:99–166).

FIG. 1G: Formula 1 motif peptide sequences obtained from a library constructed to contain variations outside the consensus core of the A6 peptide as indicated (referred to as "A6L" (SEQ ID NO: 167)) panned against IR (SEQ ID NOS:168–216).

FIG. 1H: Formula 1 motif peptide sequences obtained from a library constructed to contain variations outside the consensus core of the A6 peptide as indicated (referred to as "A6L" (SEQ ID NO: 167)) panned against IGF-R (SEQ ID NOS:217–244).

FIG. 1I: Formula 1 motif peptide sequences obtained from a library constructed to contain variations in the consensus core of the E4D peptide (SEQ ID NO: 245) (as indicated) panned against IR (SEQ ID NOS: 246–305).

FIG. 1J: Formula 1 motif peptide sequences obtained from a library constructed to contain variations in the consensus core of the E4D peptide (SEQ ID NO: 245) (as indicated) panned against IGF-1R (SEQ ID NOS:306–342).

FIG. 1K: Formula 1 motif peptide sequences obtained from a library constructed using the sequence $X_{1-6}$FHENFYDWFVRQVSX$_{21-26}$ (SEQ ID NO:343; H$_2$C-A) panned against IR (SEQ ID NOS:344430).

FIG. 1L: Formula 1 motif peptide sequences obtained from a library constructed using the sequence $X_{1-6}$FHENFYDWFVRQVSX$_{21-26}$ (SEQ ID NO:343; H2CC-A) panned against IGF-1R (SEQ ID NOS:431–467).

FIG. 1M: Formula 1 motif peptide sequences obtained from a library constructed using the sequence $X_{1-6}$FHXXFYXWFX$_{1-6}$ (SEQ ID NO:468; H$_2$C-B) and panned against IR (SEQ ID NOS:469–575).

FIG. 1N: Formula 1 motif peptide sequences obtained from a library constructed using the sequence $X_{1-6}$FHXXFYXWFX$_{16-21}$ (SEQ ID NO:468; H2C-B) and panned against IGF-1R (SEQ ID NOS:576657).

FIG. 1O: Formula 1 motif peptide sequences obtained from other libraries panned against IR (SEQ ID NOS:658–712).

FIG. 2A: Formula 4 motif peptide sequences identified from a random 20mer library panned against IR (SEQ ID NO:713).

FIG. 2B: Formula 4 motif peptide sequences identified from a library constructed to contain variations in the F8 peptide (SEQ ID NO:713) as indicated (15% dope; referred to as "F815") panned against IR (SEQ ID NOS:714–796).

FIG. 2C: Formula 4 motif peptide sequences identified from a library constructed to contain variations in the FB peptide (SEQ ID NO:713) as indicated (15% dope; referred to as "F815") panned against IGF-1R (SEQ ID NOS:797–811).

FIG. 2D: Formula 4 motif peptide sequences identified from a library constructed to contain variations in the F8 peptide (SEQ ID NO: 713)as indicated (20% dope; referred to as "F820") panned against IR (SEQ ID NOS:812–861).

FIG. 2E: Formula 4 motif peptide sequences identified from other libraries panned against IR (SEQ ID NOS:862–925).

FIG. 3A: Formula 6 motif peptide sequences identified from a random 20mer library and panned against IR (SEQ ID NOS:926–928).

FIG. 3B: Formula 6 motif peptide sequences identified from a library constructed to contain variations in the D8 peptide (SEQ ID NO: 929) as indicated (15% dope; referred to as "D815") panned against IR (SEQ ID NOS:930–967).

FIG. 3C: Formula 6 motif peptide sequences identified from a library constructed to contain variations in the D8 peptide (SEQ ID NO: 929) as indicated (20% dope; referred to as "D820") panned against IR (SEQ ID NOS:968–1010).

FIG. 3D: Formula 6 motif peptide sequences identified from a library constructed to contain variations in the D8 peptide (SEQ ID NO: 929) as indicated (20% dope; referred to as "D820") panned against IGF-1R (SEQ ID NOS:1011–1059).

FIG. 3E: Formula 6 motif peptide sequences identified from other libraries panned against IR (SEQ ID NOS:1060–1061).

FIG. 4A: Formula 10 motif peptide sequences identified from random 20mer libraries panned against IGF-1R (SEQ ID NOS:1062–1077).

FIG. 4B: Formula 10 motif peptide sequences identified from random 20mer libraries panned against IR (SEQ ID NOS:1078–1082).

FIG. 4C: Miscellaneous peptide sequences identified from a random 20mer library panned against IR (SEQ ID NOS:1083–1086).

FIG. 4D: Miscellaneous peptide sequences identified from a random 40mer library panned against IR (SEQ ID NOS:1087–1088).

FIG. 4E: Miscellaneous peptide sequences identified from a random 20mer library panned against IGF-R (SEQ ID NOS:1089–1092).

FIG. 4F: Miscellaneous peptide sequences identified from an $X_{1-4}$ C $X_{6-20}$ library and panned against IGF-1R (SEQ ID NOS:1093–113).

FIG. 4G: Miscellaneous peptide sequences identified from a library constructed to contain variations of the F8 peptide(SEQ ID NO: 1114) as indicated (F815) panned against IGF-1R (SEQ ID NOS:1115–1118).

FIG. 4H: Miscellaneous peptide sequences identified from a library constructed to contain variations in the F8A11 peptide(SEQ ID NO: 1119) as indicated (referred to as "NNKH") panned against IR (SEQ ID NOS:1120–1142).

FIG. 4I: Miscellaneous peptide sequences identified from a library constructed to contain variations in the F8A1 1 peptide(SEQ ID NO: 1119) as indicated (referred to as "NNKH") panned against IGF-1R (SEQ ID NOS:1143–1154).

FIG. 5A: Summary of specific representative amino acid sequences from Formulas 1,4, 6, and 10 (SEQ ID NOS:1155–1180).

FIG. 5B: Summary of specific representative amino acid sequences from Formulas 1, 4, 6, and 10 (SEQ ID NOS:1181–1220).

Figure 6:
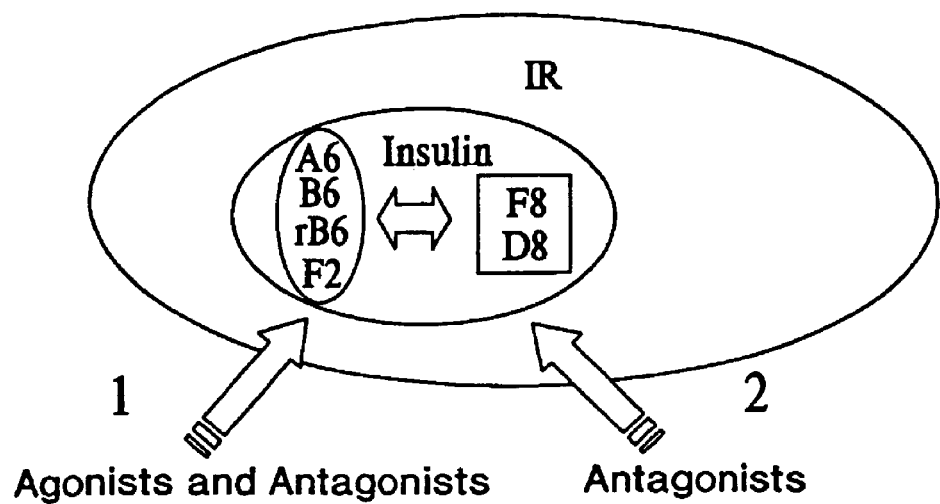

FIG. 6: Illustration of 2 binding site domains on IR based on competition data.

Figure 7:
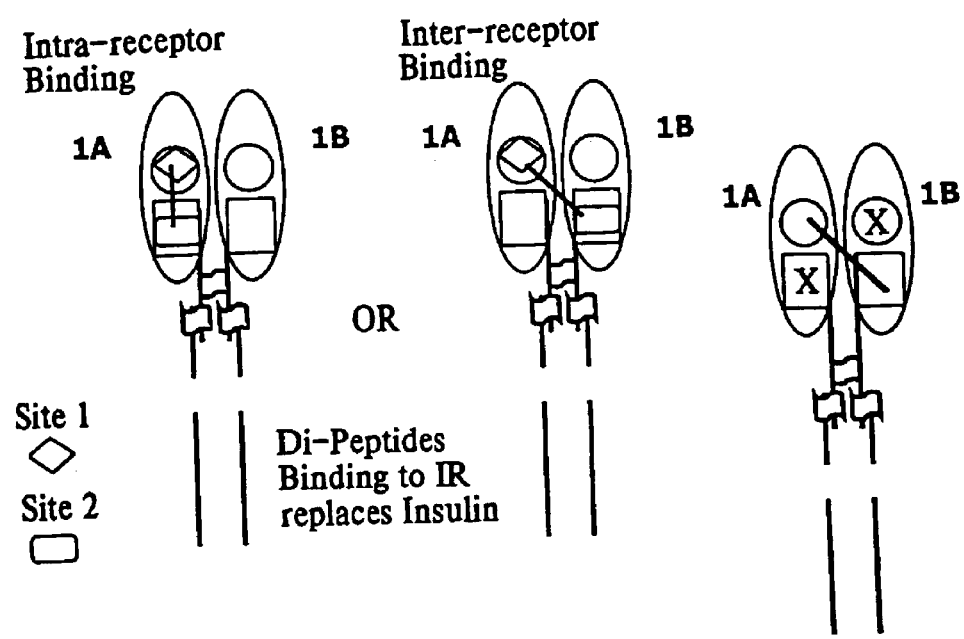

FIG. 7: Schematic illustration of potential binding schemes to the multiple binding sites on IR.

FIG. 8: Biopanning results and sequence alignments of Group 1 of IR-binding peptides (SEQ ID NOS: 1221–1243). The number of sequences found is indicated on the right side of the figure together with data on the phage binding to either IR or IGF-1R receptor. Absorbance signals are indicated by: ++++, >30X over background; +++, 15–30X; ++, 5–15X; +, 2–5X; and 0, <2X.

FIGS. 9A–9B: Biopanning results and sequence alignments of Groups 2, 6, and 7 of IR-binding peptides (SEQ ID NOS:1244–1261). The number of sequences found is indicated on the right side of the figure together with data on the phage binding to either IR or IGF-1R receptor. Absorbance signals are indicated by: ++++, >30X over background; +++, 15–30X; ++, 5–15X; +, 2–5X; and 0, <2X.

FIGS. 10A–10C: Insulin competition data determined for various monomer and dimer peptides. FIG. 10A shows the competition curve. FIG. 10B shows the symbol key for the peptides. FIG. 10C shows the description of the peptides.

FIGS. 11A–11D: Insulin competition data determined for various monomer and dimer peptides. FIG. 11A shows the competition curve. FIG. 11B shows the symbol key for the peptides. FIG. 11C shows the description of the peptides. FIG. 11D shows IR binding affinity for the peptides.

Figure 12D:
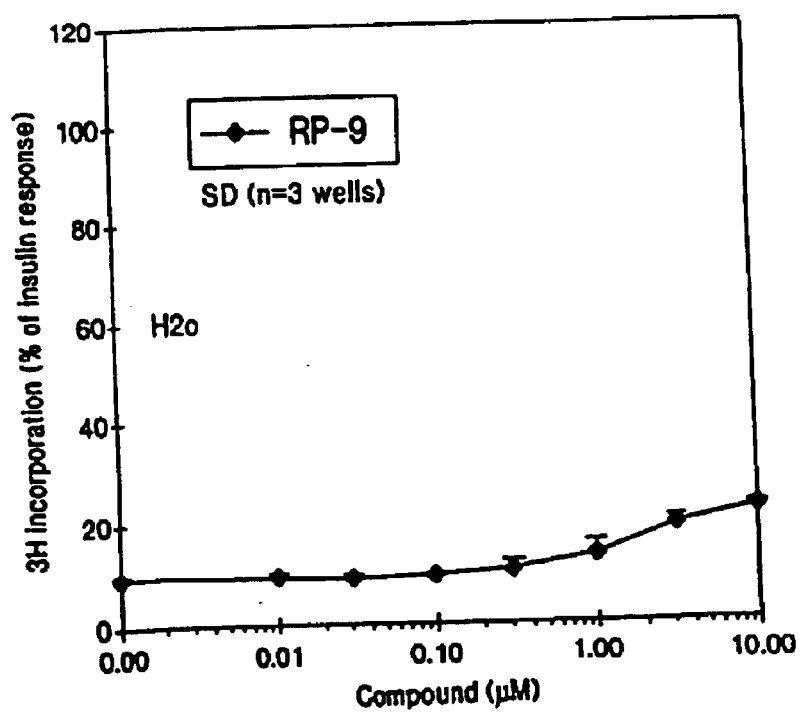

FIGS. 12A–12D: Results of free fat cell assays for truncated synthetic RP9 monomer peptides, S390 and S394. FIG. 12A shows the results for peptide S390. FIG. 12B shows the results for peptide S394. FIG. 12C shows the amino acid sequence of peptides S390 and S394 (SEQ ID NOS:1794 and 1788, respectively in order of appearance). FIG. 12D shows the results for full-length RP9 peptide.

FIGS. 13A–13C: Results of free fat cell assays for truncated synthetic RP9 dimer peptides, S415 and S417. FIG. 13A shows the results for peptide S415. FIG. 13B shows the results for peptide S417. FIG. 13C shows the amino acid sequence of peptides S415 and S417 (SEQ ID NOS:1795–1796).

FIGS. 14A–14C: Results of free fat cell assays for RP9 homodimer peptides, 521 and 535. FIG. 14A shows the results for peptide 521. FIG. 14B shows the results for peptide 535. FIG. 14C shows the amino acid sequence of peptides 521 and 535.

Figures 15A, 15B:
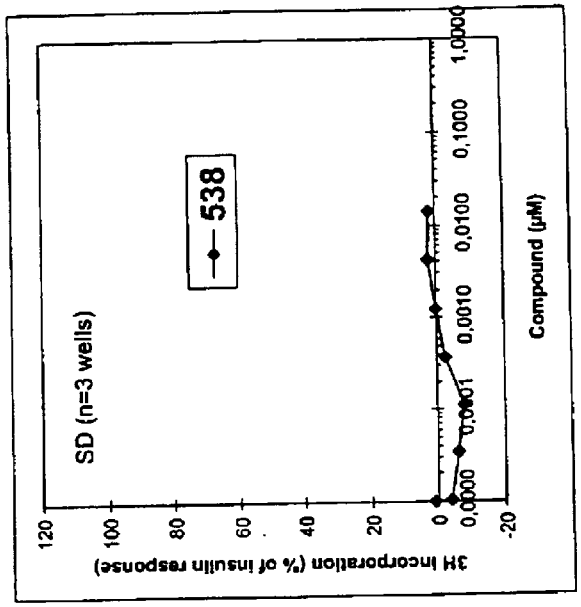
Figure 15C:
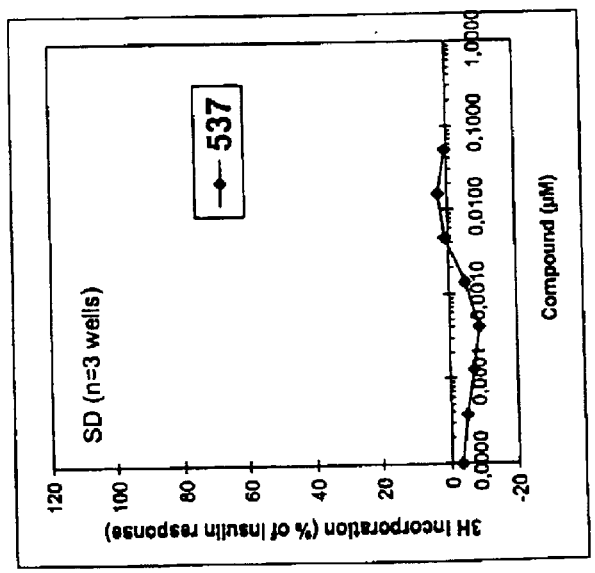

FIGS. 15A–15C: Results of free fat cell assays for RP9-D8 heterodimer peptides, 537 and 538. FIG. 15A shows the results for peptide 537. FIG. 15B shows the results for peptide 538. FIG. 15C shows the amino acid sequence of peptides 537 and 538.

FIGS. 16A–16C: Results of free fat cell assays for RP9-D8 heterodimer peptides 537 and 538. FIG. 16A shows the results for peptide 537. FIG. 16B shows the results for peptide 538. FIG. 16C shows the amino acid sequence of peptides 537 and 538.

Figures 17A, 17B:
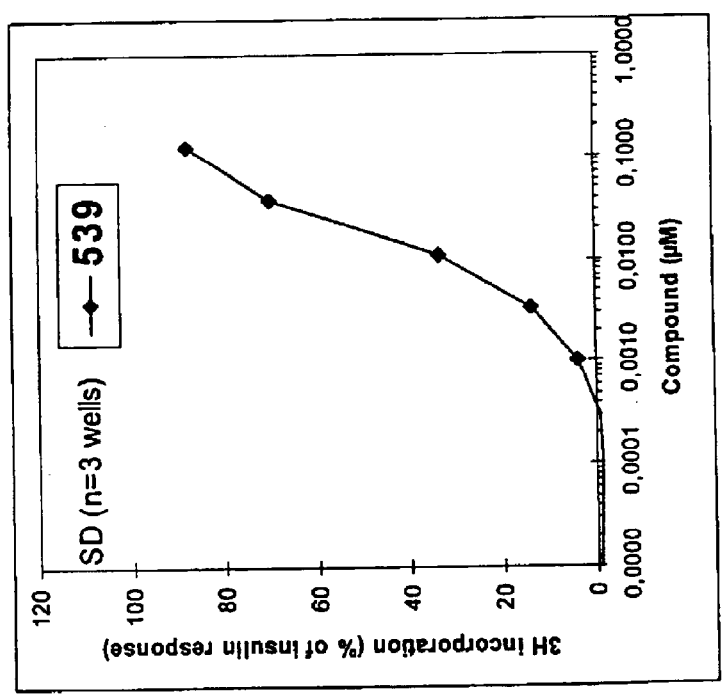

FIGS. 17A–17B: Results of free fat-cell assays for D8-RP9 heterodimer peptide, 539. FIG. 17A shows the results for peptide 539. FIG. 17B shows the amino acid sequence of peptide 539.

FIGS. 18A–18D: Results of free fat cell assays for Site 1/Site 2 dimer peptides with constituent monomer peptides with Site 1-Site 2 C—N (FIG. 18A), Site 1-Site 2, N—N (FIG. 18B), Site 1-Site 2, C—C (FIG. 18C), and Site 2-Site 1, C—N (FIG. 18D) orientations and linkages, respectively.

Figures 19A, 19B:
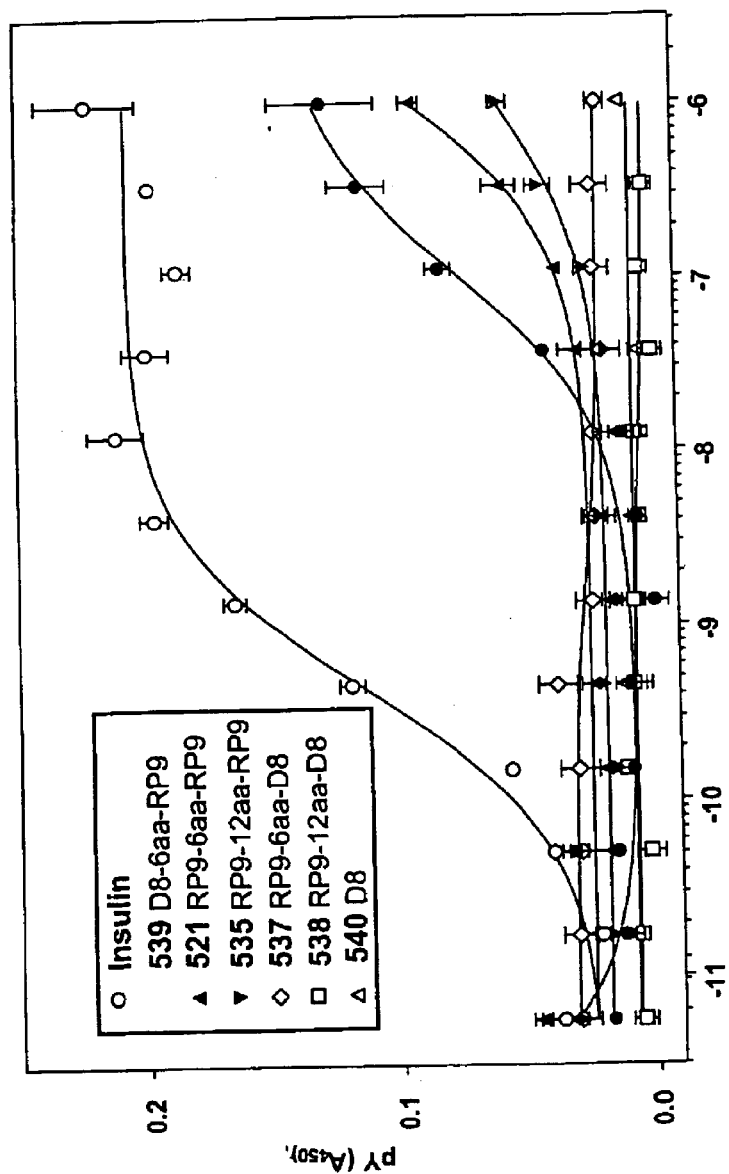

FIGS. 19A–19B: Results of human insulin receptor kinase assays for various monomer and dimer peptides. FIG. 19A shows the substrate phosphorylation curve. FIG. 19B shows the $EC_{50}$ values.

Figures 20A, 20B:
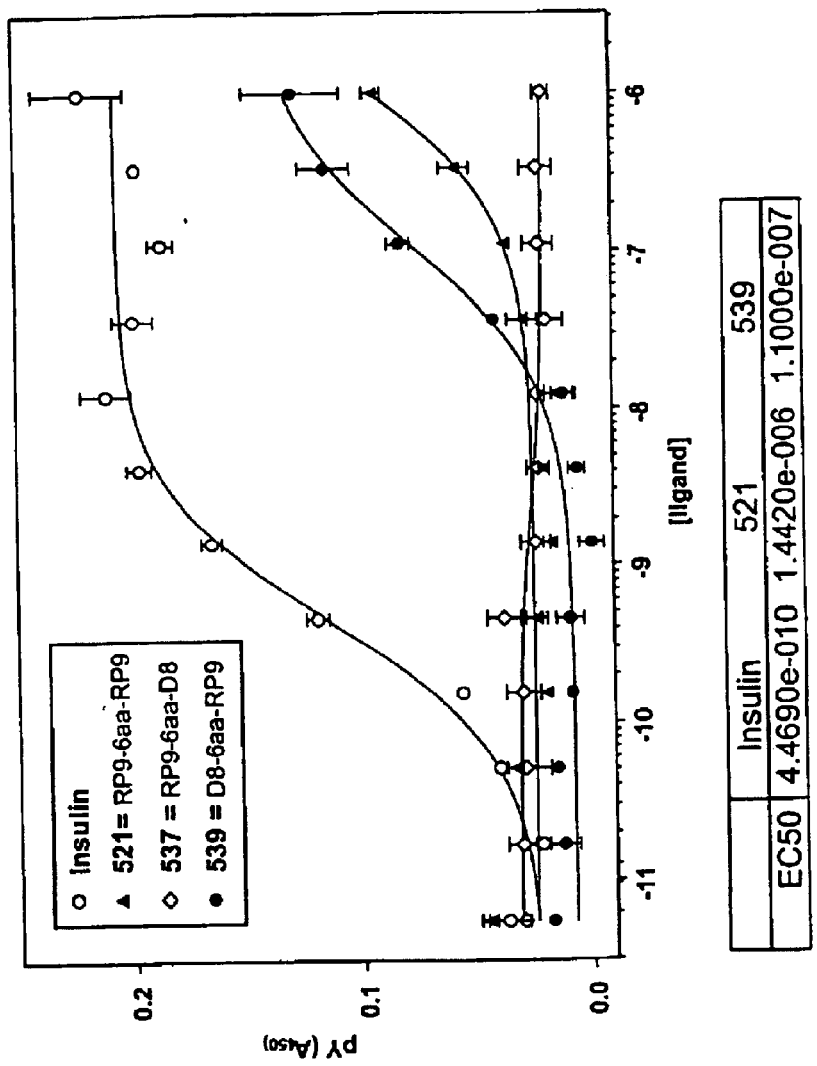

FIGS. 20A–20B: Results of human insulin receptor kinase assays for Site 1-Site 2 and Site 2-Site 1 dimer peptides. FIG. 20A shows the substrate phosphorylation curve. FIG. 20B shows the $EC_{50}$ values.

FIGS. 21A–21B: Results of human insulin receptor kinase assays for Site 1-Site 2 and Site 2-Site 1 peptides. FIG. 21A shows the substrate phosphorylation curve. FIG. 21B shows the $EC_{50}$ values.

Figures 22A, 22B:
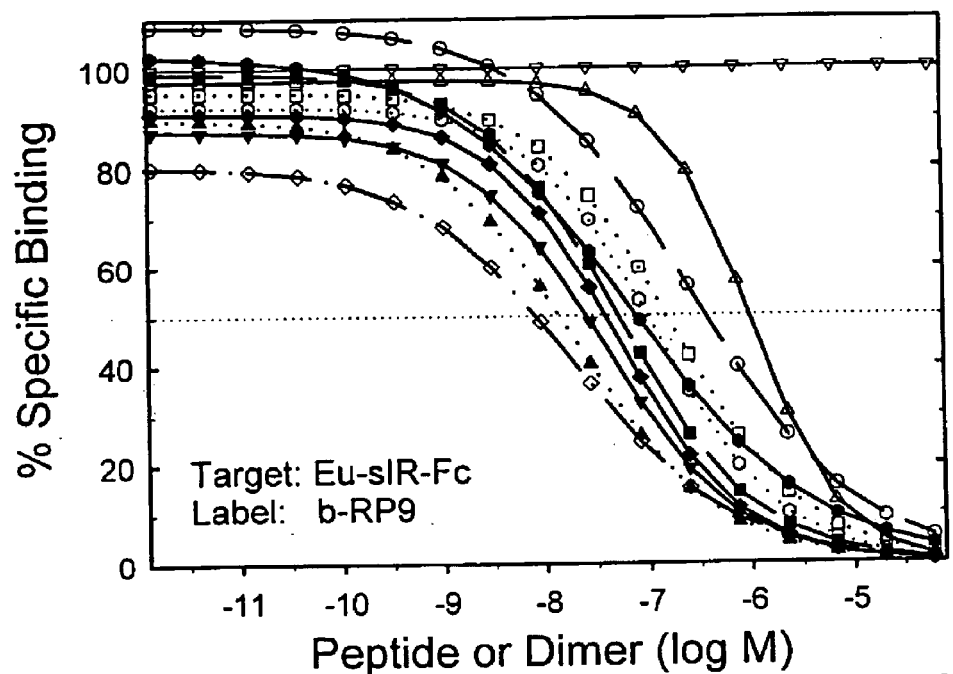

FIGS. 22A–22B: Results of time-resolved fluorescence resonance transfer assays for assessing the ability of various monomer and dimer peptides to compete with biotinylated RP9 monomer peptide for binding to soluble human insulin receptor-immunoglobulin heavy chain chimera. FIG. 22A shows the binding curve. FIG. 22B shows the symbol key and description of the peptide sequences (SEQ ID NOS:2117, 1916–1917, 1558, 11994, 1960–1961, 2008, 1794, 2015–2016, 1560, and 2001–2002, respectively in order of appearance).

FIGS. 23A–23C: Results of time-resolved fluorescence resonance transfer assays indicating the ability of various monomer and dimer peptide to compete with biotinylated S175 monomer peptide or biotinylated RP9 monomer peptide for binding to soluble human insulin receptor-immunoglobulin heavy chain chimera. FIGS. 23A–23B show the binding curves. FIG. 23C shows the symbol key and description of the peptide sequences (SEQ ID NOS:2117, 1916–1917, 1558, 1994, 1960–1961, 2008, 1794, 2015–2016, 1560, and 2001–2002, respectively in order of appearance).

Figures 24A, 24B:
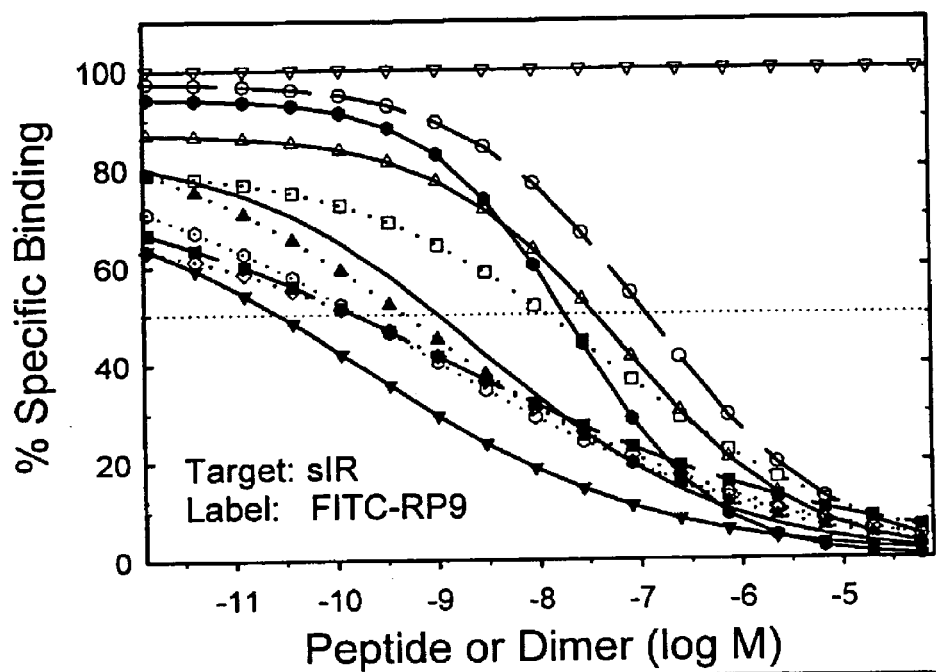

FIGS. 24A–24B: Results of fluorescence polarization assays indicating the ability of various monomer and dimer peptide to compete with fluoroscein labeled RP9 monomer peptide for binding to soluble human insulin receptor ectodomain. FIG. 24A shows the binding curve. FIG. 24B shows the symbol key and description of the peptide sequences (SEQ ID NOS:2117, 1916–1917, 1558, 1994, 1960–1961, 2008, 1794, 2015–2016, 1560 and 2001–2002, respectively in order of appearance).

Figures 25A, 25B:
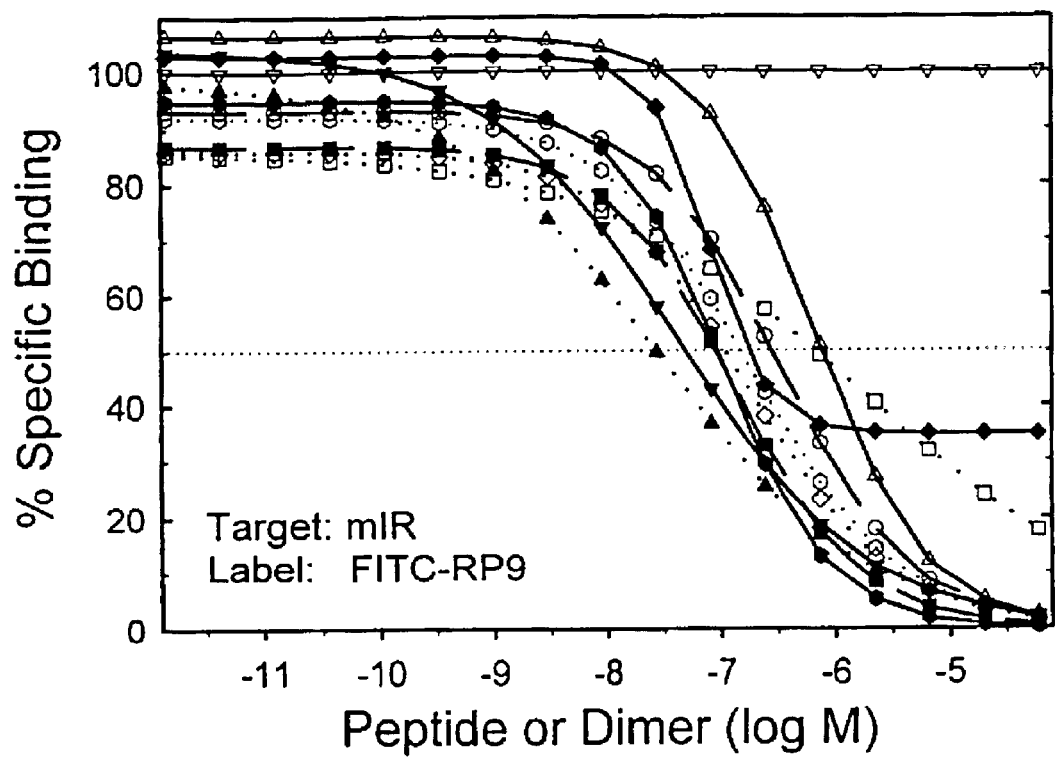

FIGS. 25A–25B: Results of fluorescence polarization assays indicating the ability of various monomer and dimer peptides to compete with fluoroscein labeled RP9 monomer peptide for binding to soluble human insulin mini-receptor. FIG. 25A shows the binding curve. FIG. 25B shows the symbol key and description of the peptide sequences (SEQ ID NOS:2117, 1916–1917, 1558, 1994, 1960–1961, 2008, 1794, 2015–2016, 1560, and 2001–2002, respectively in order of appearance).

Figures 26A, 26B:
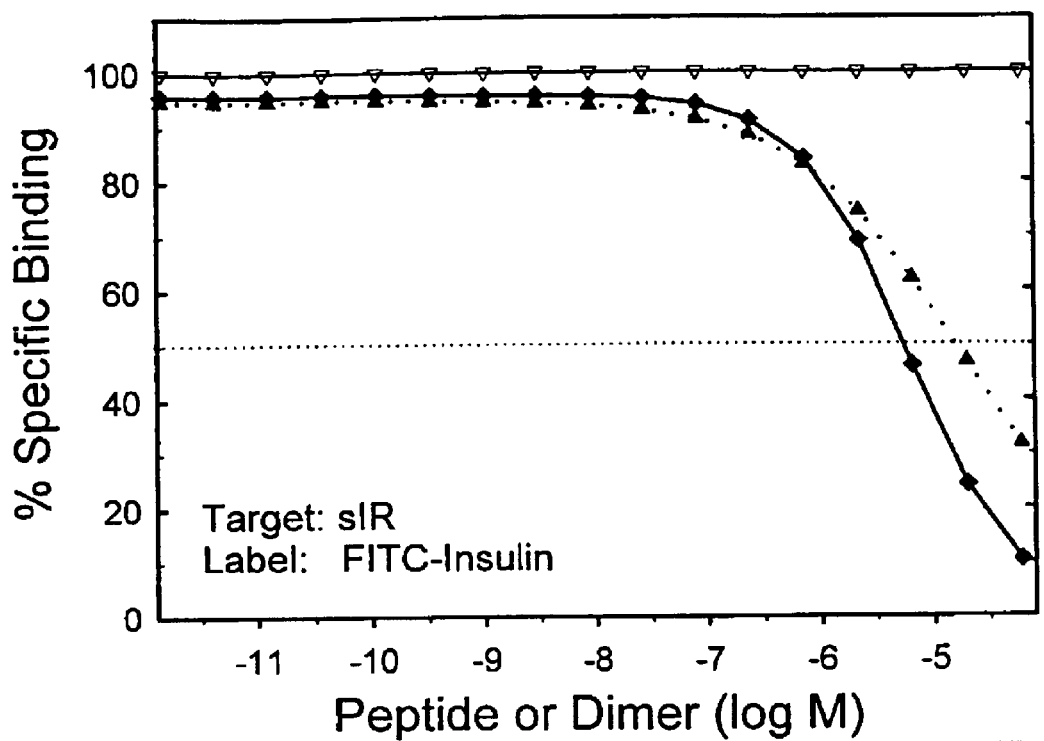

FIGS. 26A–26B: Results of fluorescence polarization assays indicating the ability of various monomer and dimer peptides to compete with fluorescein labeled insulin for binding to soluble human insulin receptor ectodomain. FIG. 26A shows the binding curve. FIG. 26B shows the symbol key and description of the peptide sequences (SEQ ID NOS:2117, 1916–1917, 1558, 1994, 1960–1961, 2008, 1794, 2015–2016, 1560, and 2001–2002, respectively in order of appearance).

Figures 27A, 27B:
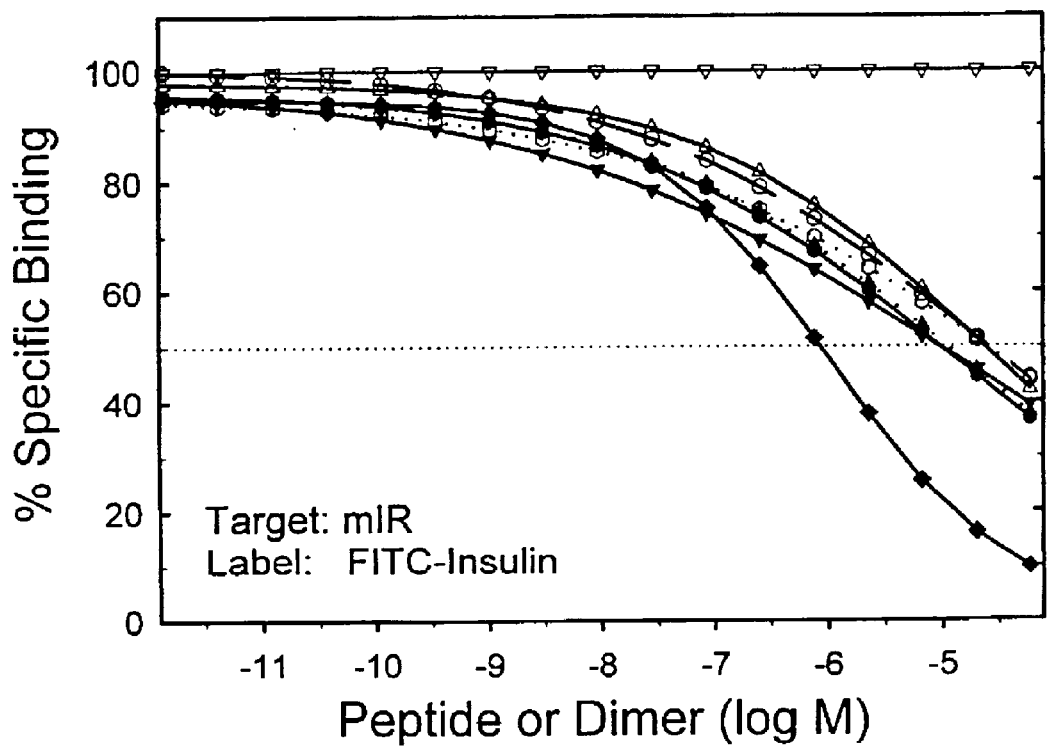

FIGS. 27A–27B: Results of fluorescence polarization assays indicating the ability of various monomer and dimer peptides to compete with fluorescein labeled insulin for binding to soluble human insulin mini-receptor. FIG. 27A shows the binding curve. FIG. 27B shows the symbol key and description of the peptide sequences (SEQ ID NOS:2117, 1916–1917, 1558, 1994, 1960–1961, 2008, 1794, 2015–2016, 1560, and 2001–2002, respectively in order of appearance).

Figure 28:
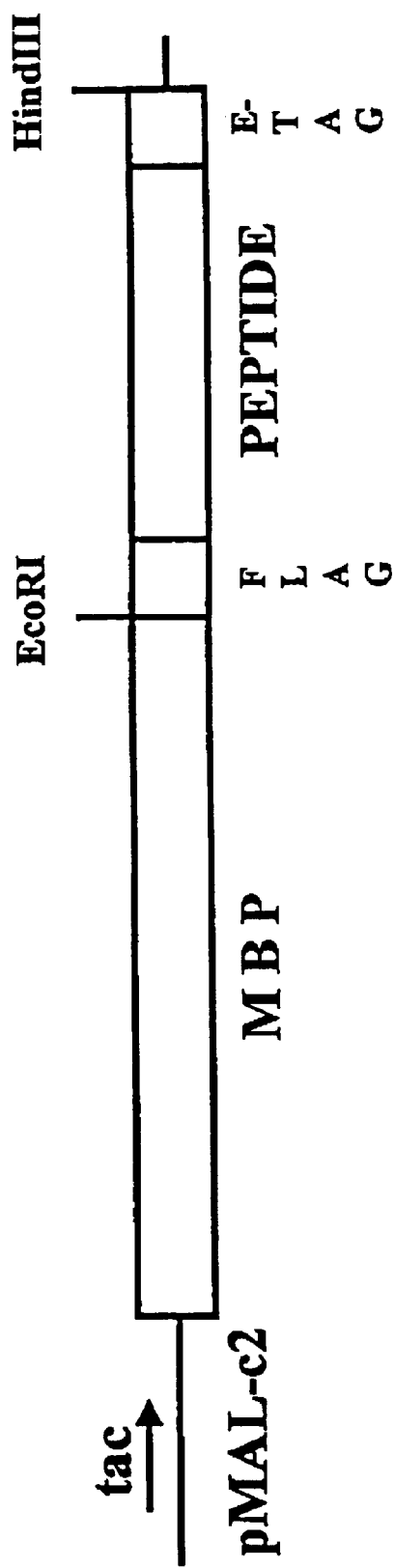

FIG. 28: A schematic drawing for the construction of protein fusions of the maltose binding protein.

Figure 29:
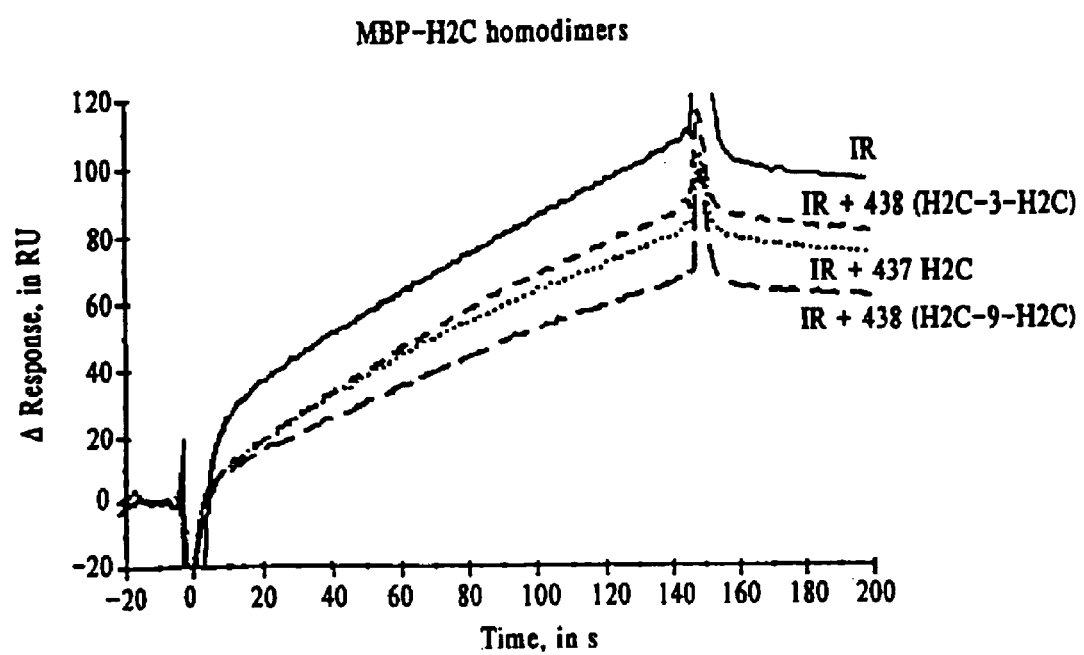

FIG. 29: BIAcore analysis of competition binding between IR and maltose binding protein fusion peptides $H_2C$-9aa-$H_2C$, $H_2C$, and $H_2C$-3aa-$H_2C$.

Figure 30:
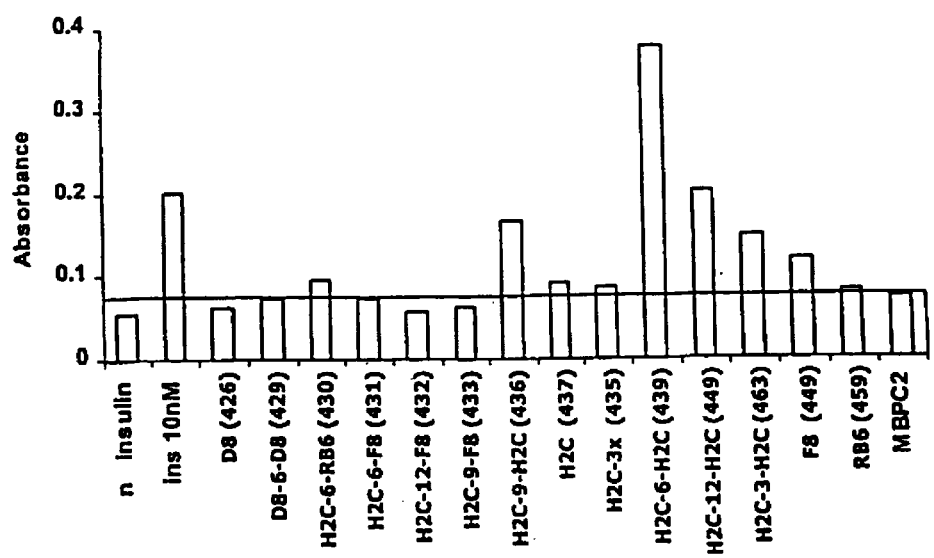

FIG. 30: Stimulation of IR autophosphorylation in vivo by maltose binding protein fusion peptides.

Figures 31A, 31B:
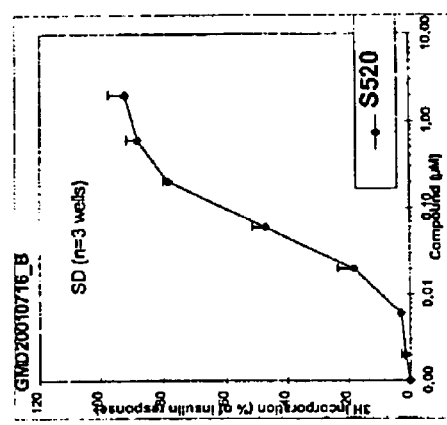
Figure 31C:
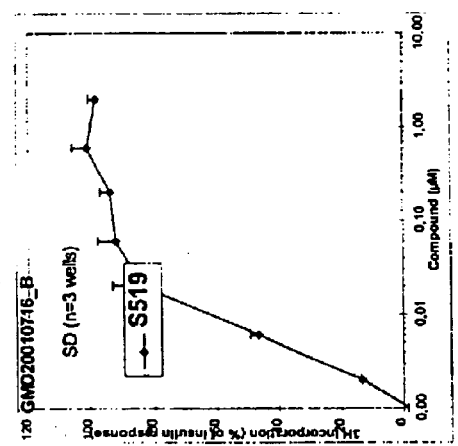

FIGS. 31A–31C: Results of free fat cell assays for insulin and Site 2-Site 1 peptides, S519 and S520. FIG. 31A shows the results for S519. FIG. 31B shows the results for S520. FIG. 31C shows the $EC_{50}$ values.

Figures 32A, 32B:
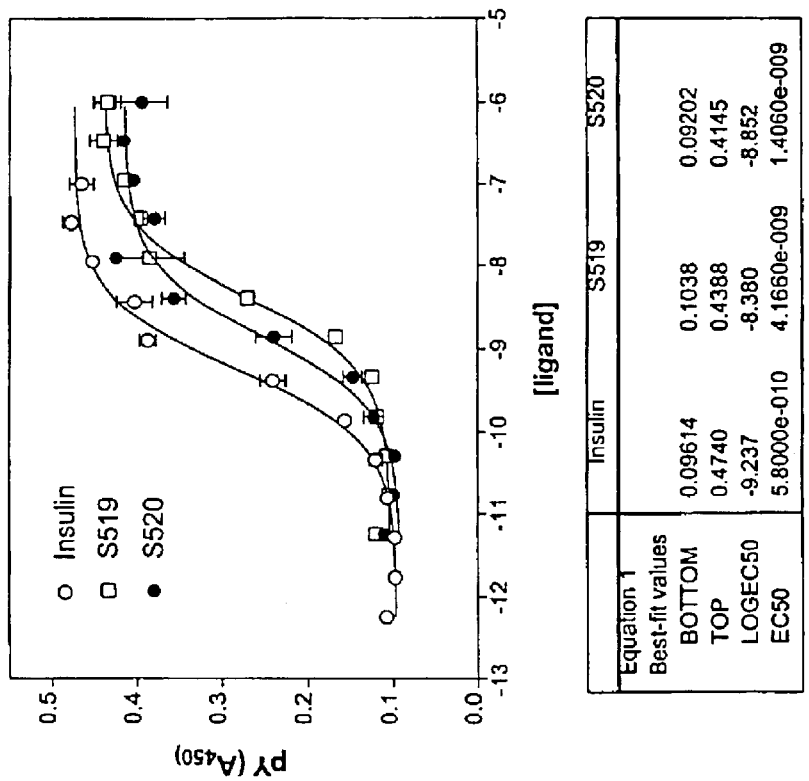

FIGS. 32A–32B: Results of human insulin receptor kinase assays for insulin and Site 2-Site 1 peptides S519 and S520. FIG. 32A shows the substrate phosphorylation curve. FIG. 32B shows the calculated Bestfit values.

Figure 33:
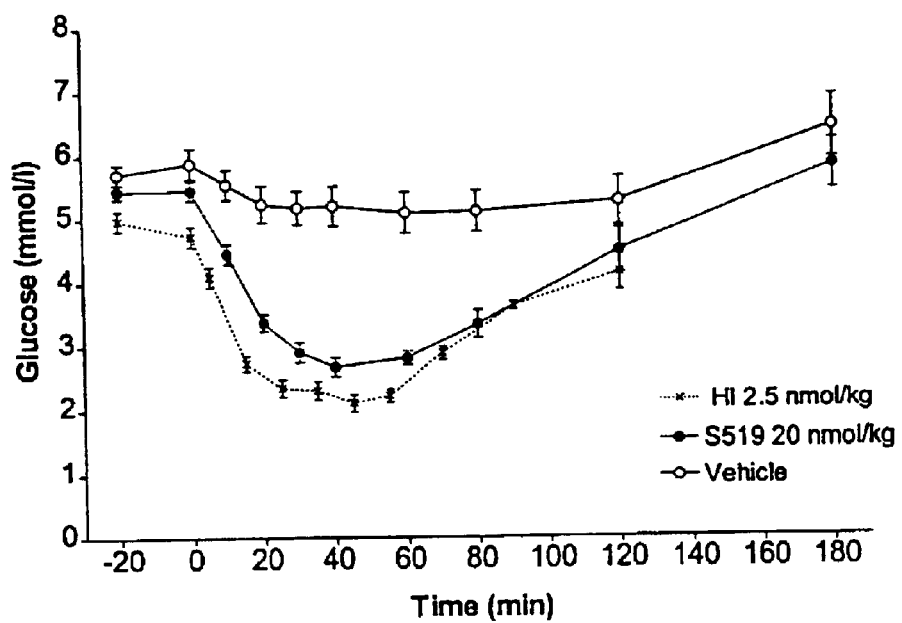

FIG. 33: Results of in vivo experiments showing the effect of intravenous administration of Site 2-Site 1 peptide S519 in Wistar rats:

FIGS. 34A–34E: Results of phage competition studies with IGF-1 surrogates RP9 (Site 1) and D815 (Site 2) peptides. Phage: RP9 (A6-like); RP6 (B6-like); D8B12 (Site 2); and D815 (Site 2); Peptides: RP9 and D815. FIGS. 34A–34B show the competition curves. FIGS. 34C–34E show the symbol keys and peptide groups.

Figure 35B:
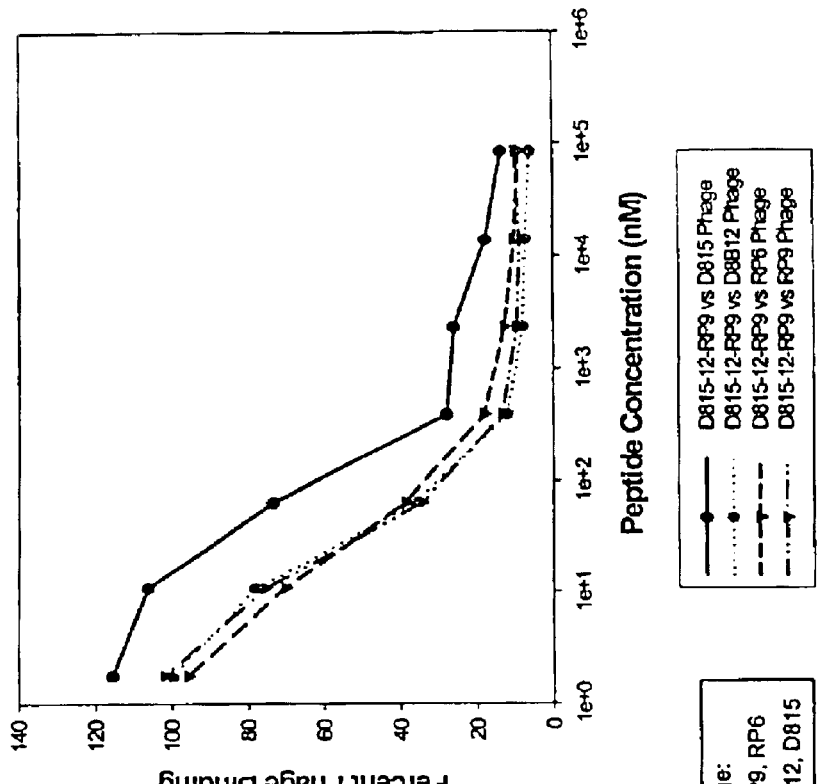
Figure 35A:
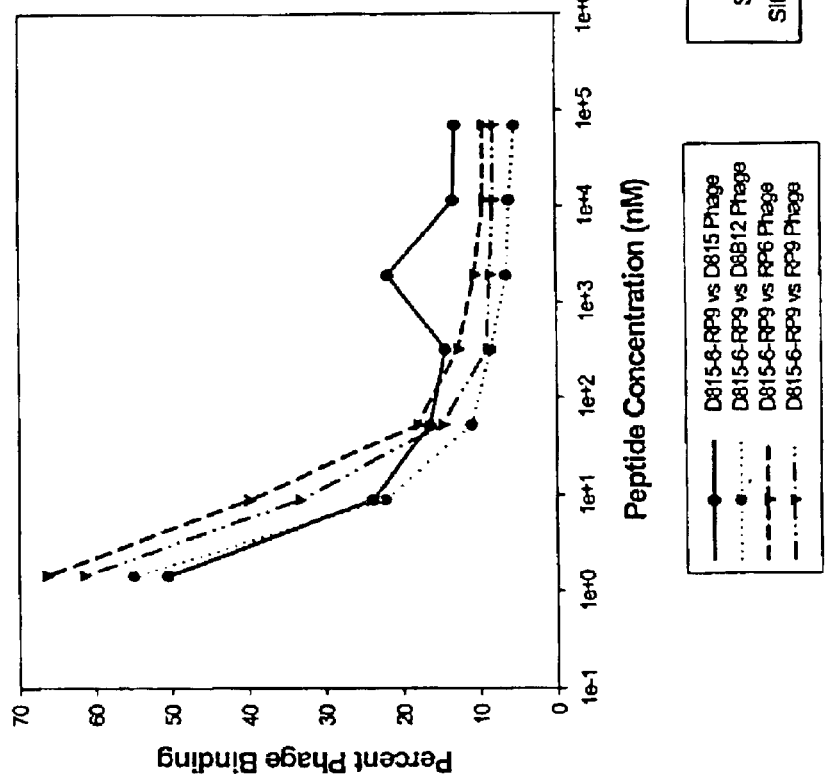

FIGS. 35A–35E: Phage competition studies with Site 2-Site 1 dimer peptides containing 6- or 12-amino acid linkers. Phage: RP9, RP6, D8B12, and D815; Peptides: D815-6L-RP9 and D815-12L-RP9. FIGS. 35A–35B show the competition curves. FIGS. 35C–35E show the symbol keys and peptide groups.

Figure 36:
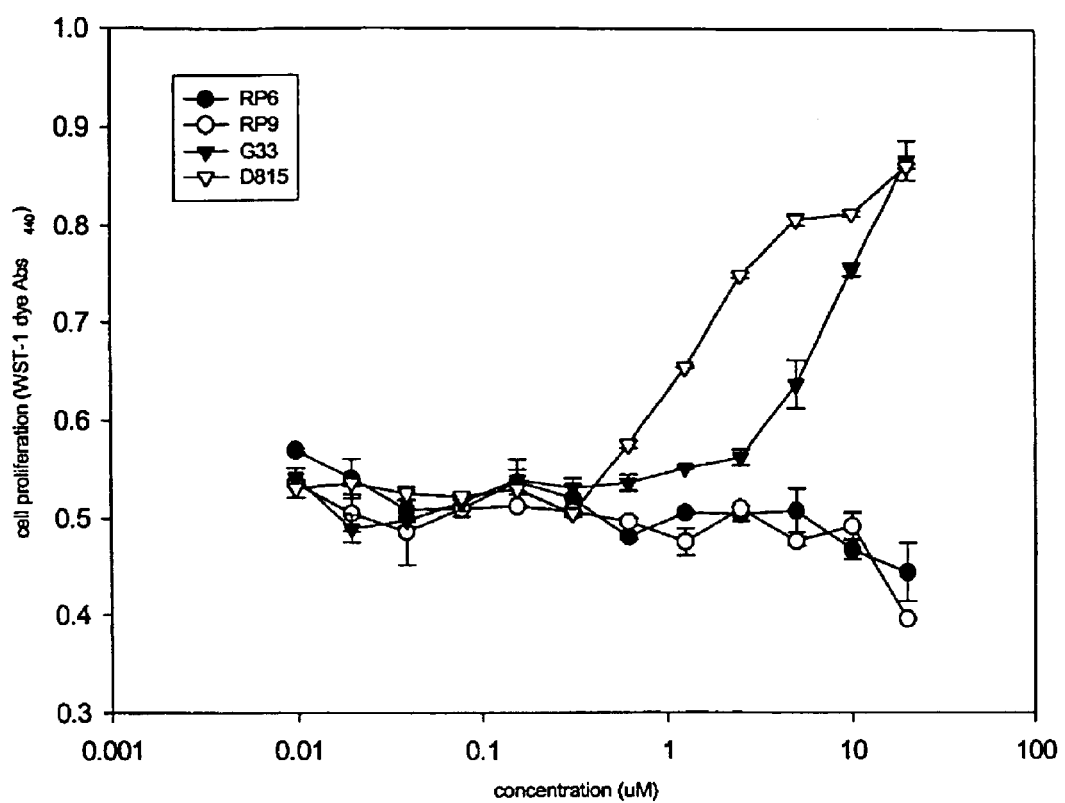

FIG. 36: Results of IGF-1 agonist assay using FDCP-2 cells. Site 1 peptides RP6, RP9, G33, and Site 2 peptide D815 were tested in the agonist assay.

Figure 37:
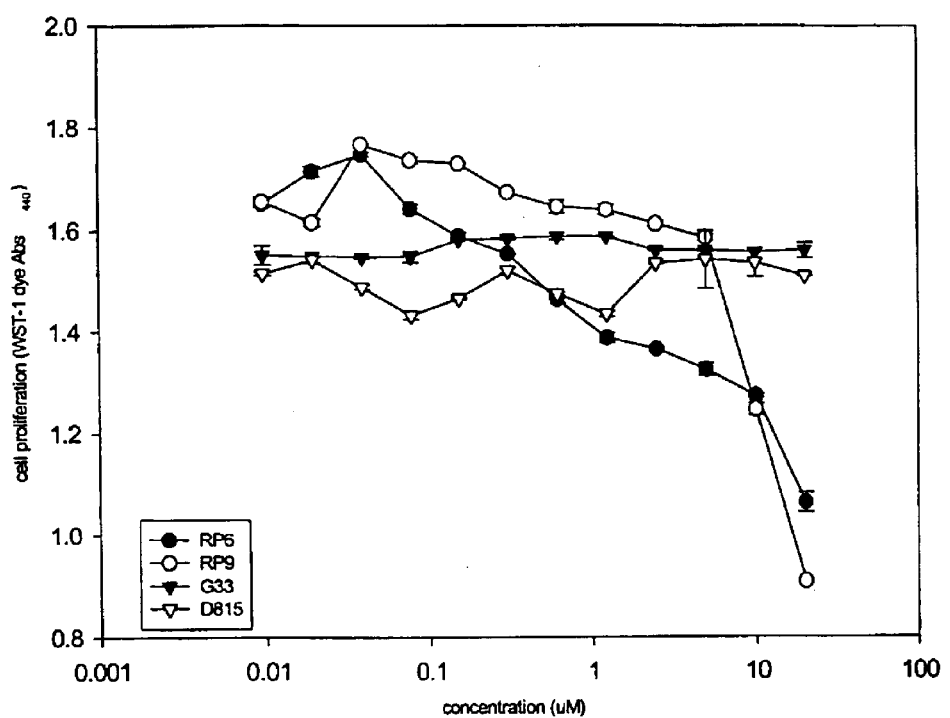

FIG. 37: Results of IGF-1 antagonist assay using FDCP-2 cells. Site 1 peptides RP6, RP9, G33, and Site 2 peptide D815 were tested in the antagonist assay.

Figure 38:
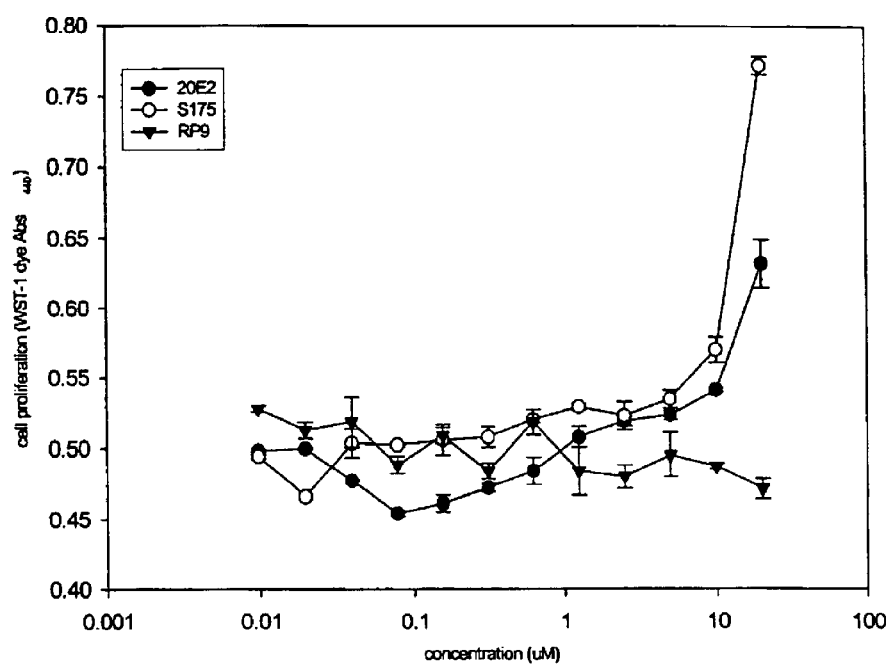

FIG. 38: Results of IGF-1 agonist assay using FDCP-2 cells. Site 1 peptides 20E2, S175, and RP9 were tested in the agonist assay.

Figure 39:
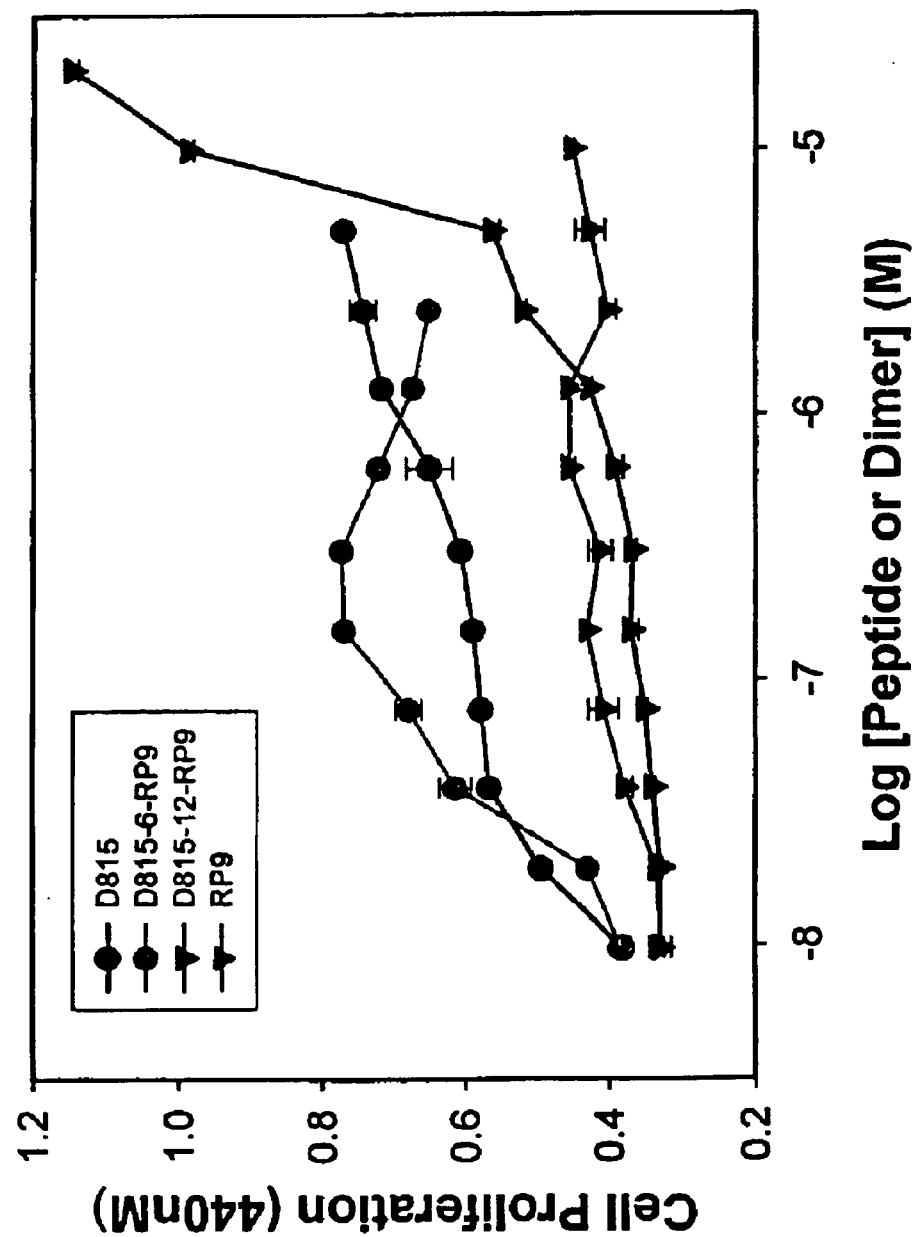

FIG. 39: Results of agonist and antagonist studies with surrogate monomers and dimers. Monomers: D815 and RP9; Dimers: D815-6aa-RP9 and D815-12aa-RP9.

Figure 40:
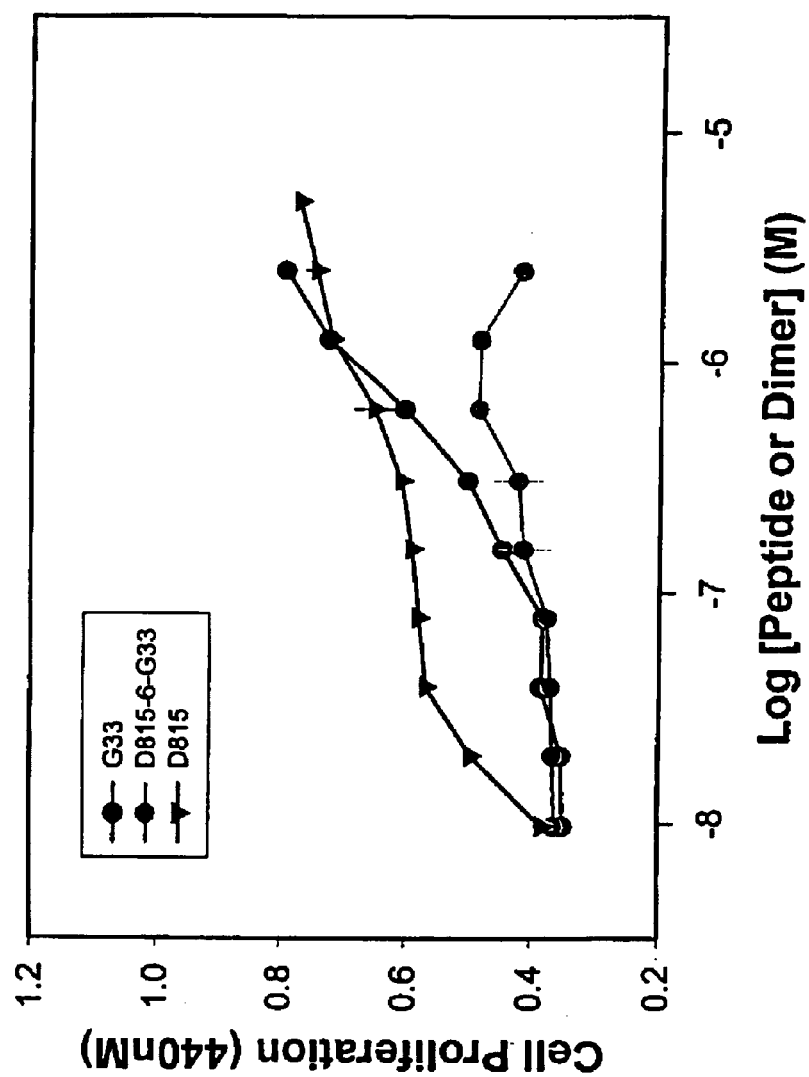

FIG. 40: Results of agonist and antagonist studies with surrogate monomers and dimers. Monomers: G33 and D815; Dimer: D8156aa-G33.

Figure 41:
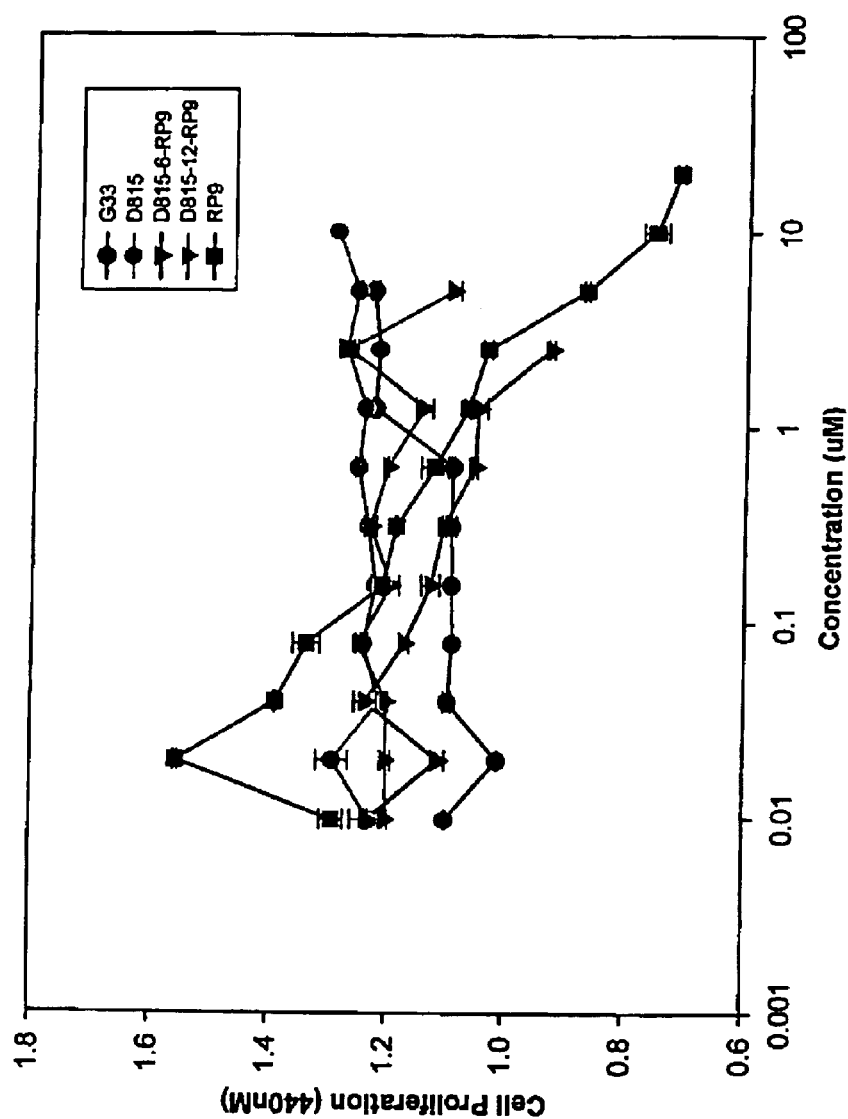

FIG. 41: Results of agonist and antagonist studies with surrogate peptides and dimers. Monomers: G33, D815 and RP9; Dimers: D815-6aa-RP9 and D81512aa-RP9.

Figure 42:
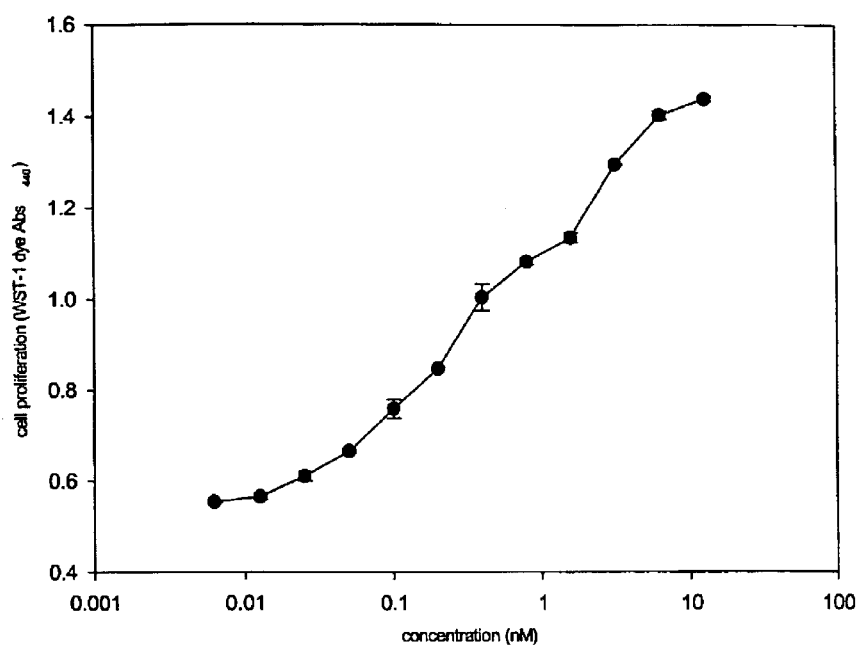

FIG. 42: IGF-1 standard curve using FDCP-2 cells.

FIGS. 43A–43B: Peptide monomers identified from G33 and RP6 secondary libraries panned against IGF-1R (SEQ ID NOS:1262–1432). FIG. 43A shows peptides from G33 secondary library: FIG. 43B shows peptides from RP6 secondary library.

FIGS. 44A–44B: Peptide dimers identified from libraries panned against IR or IGF-1R (SEQ ID NOS:1433–1540). FIG. 44A shows dimer peptides panned against IR; FIG. 44B shows dimer peptides panned against IGF-1R.

Figure 45:
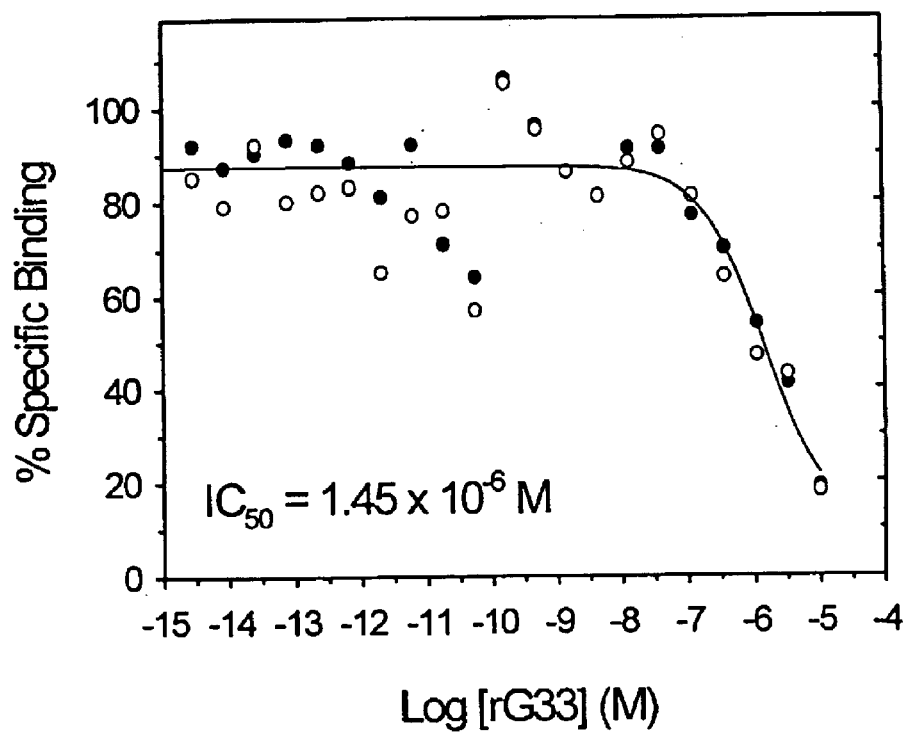

FIG. 45: Results of heterogeneous time-resolved fluorometric assays showing the effect of recombinant peptide surrogate G33 (rG33) on the binding of biotinylated-recombinant human IGF-1 (b-rhIGF-1) to recombinant human IGF-R (rhIGF-1R).

Figure 46:
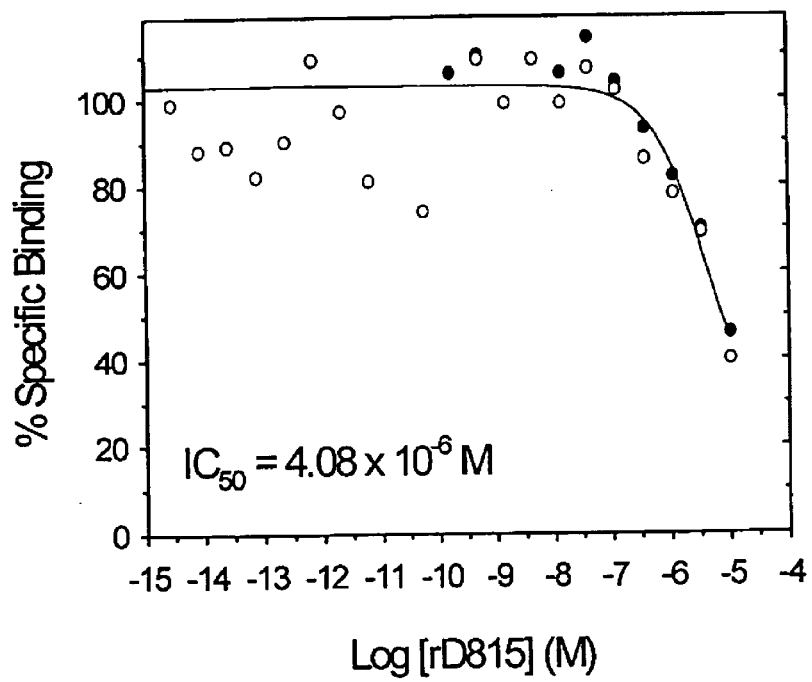

FIG. 46: Results of heterogeneous time-resolved fluorometric assays showing the effect of recombinant peptide surrogate D815 (rD815) on the binding of biotinylated-recombinant human IGF-1 (b-rhIGF-1) to recombinant human IGF-1R (rhIGF-1 R).

Figure 47:
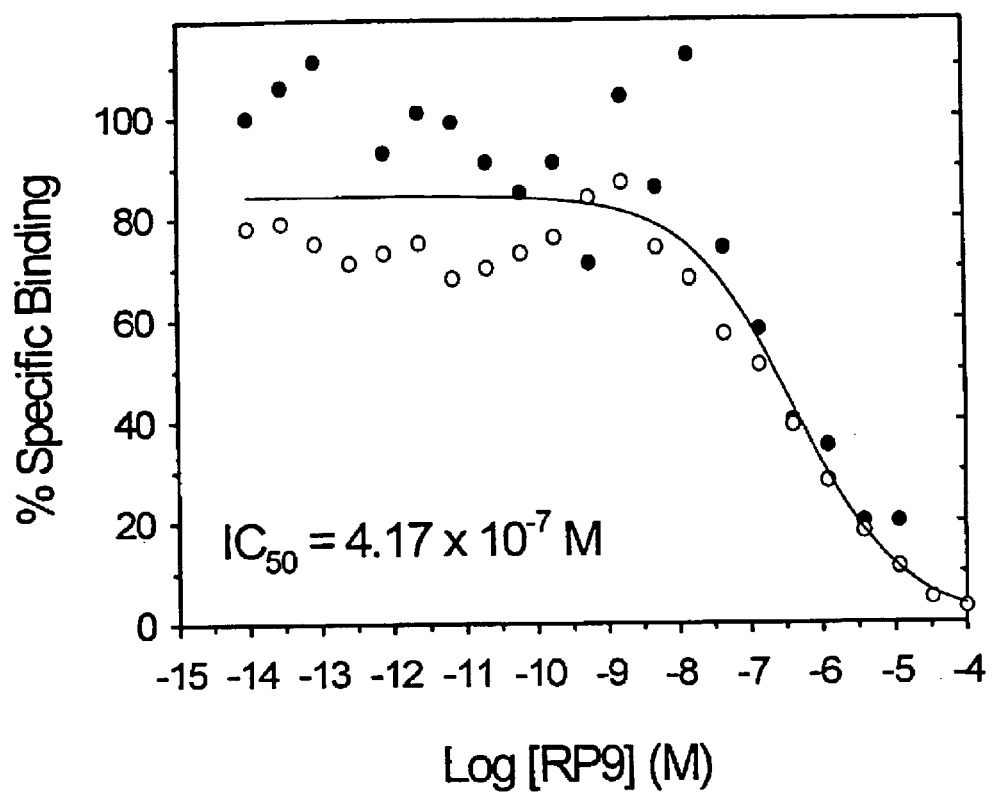

FIG. 47: Results of heterogeneous time-resolved fluorometric assays showing the effect of recombinant peptide surrogate RP9 on the binding of biotinylated-recombinant human IGF-1 (b-rhIGF-1) to recombinant human IGF-1R (rhIGF-1 R).

Figure 48:
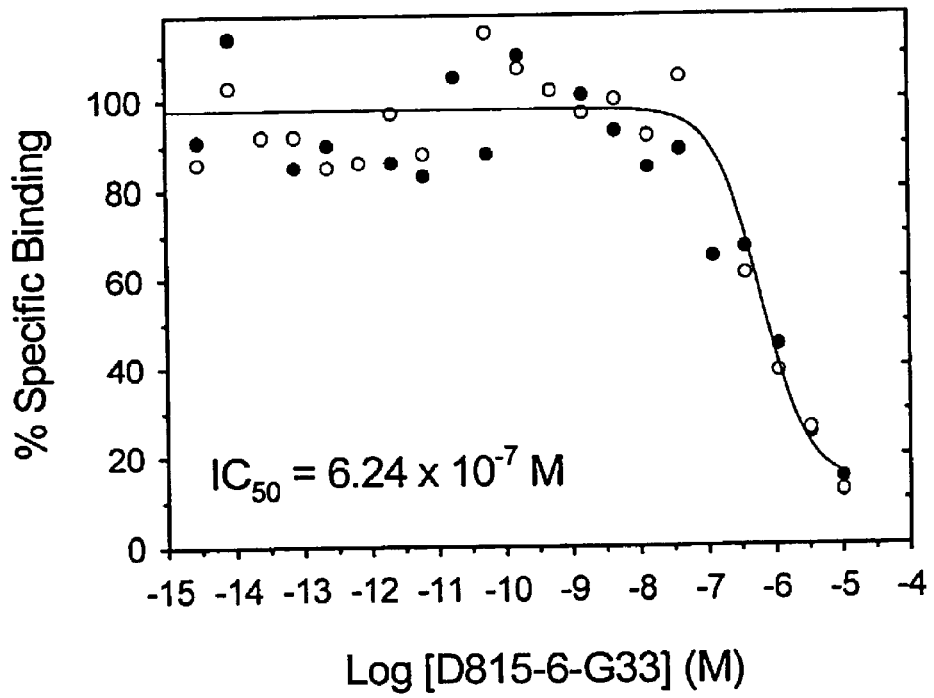

FIG. 48: Results of heterogeneous time-resolved fluorometric assay showing the effect of recombinant peptide surrogate D815-6-G33 on the binding of biotinylated-recombinant human IGF-1 (b-rhIGF-1) to recombinant human IGF-1R (rhIGF-1 R).

Figure 49:
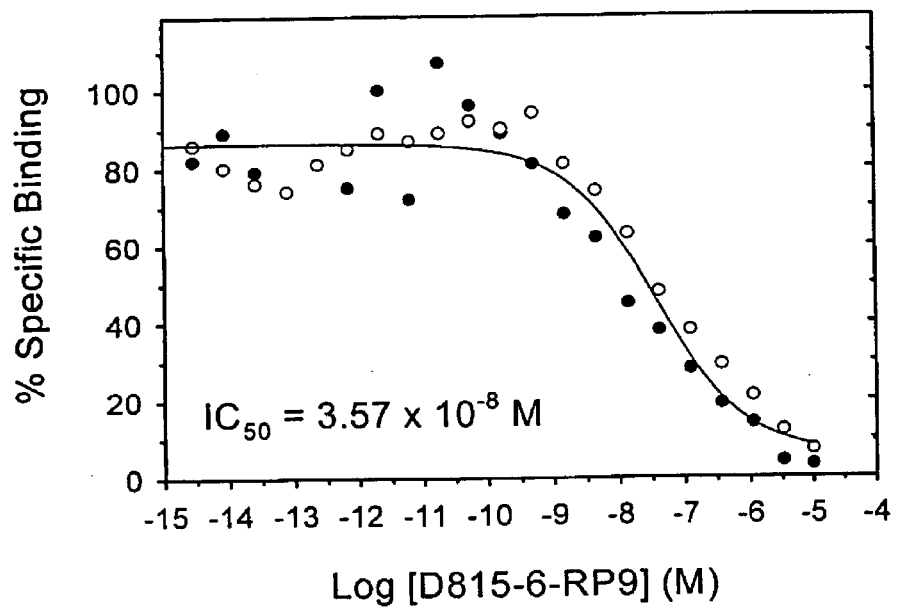

FIG. 49: Results of heterogeneous time-resolved fluorometric assays showing the effect of recombinant peptide surrogate D815-6-RP9 on the binding of biotinylated-recombinant human IGF-1 (b-rhIGF-1) to recombinant human IGF-1R (rhIGF-1 R).

Figure 50:
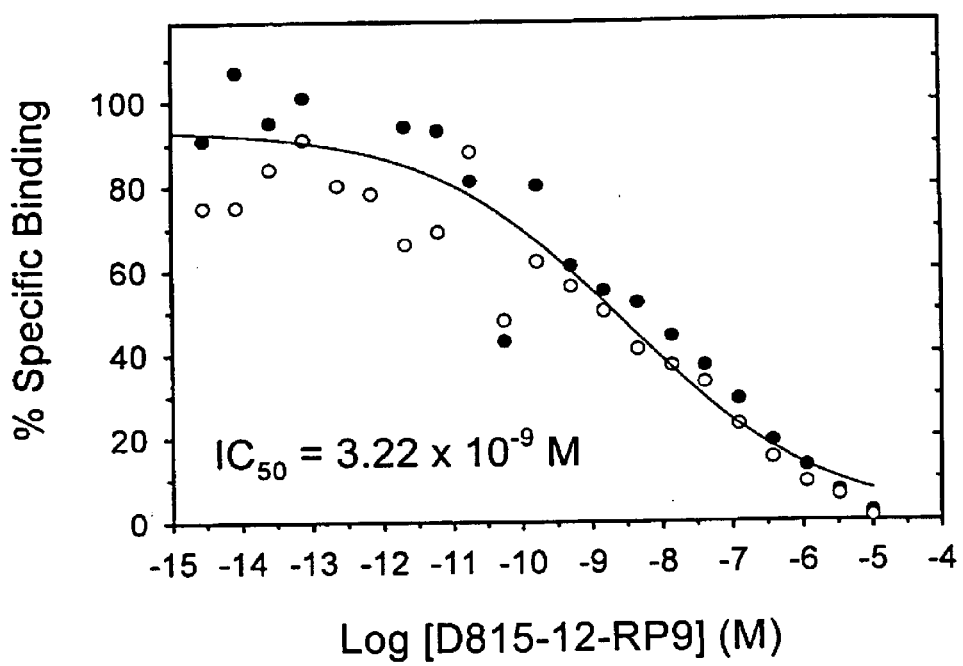

FIG. 50; Results of heterogeneous time-resolved fluorometric assays showing the effect of recombinant peptide surrogate D815-12-RP9 on the binding of biotinylated-recombinant human IGF-1 (b-rhIGF-1) to recombinant human IGF-1R (rhIGF-1 R).

Figure 51:
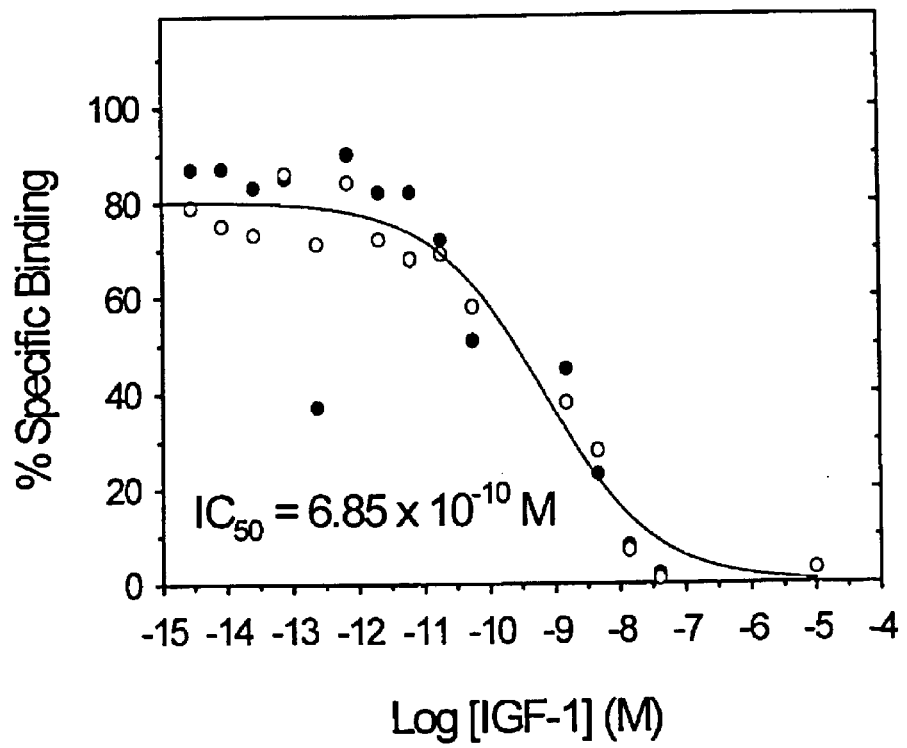

FIG. 51: Results of heterogeneous time-resolved fluorometric assays showing the effect of IGF-1 on the binding of biotinylated-recombinant human IGF-1 (b-rhIGF-1) to recombinant human IGF-1R (rhIGF-1 R).

Figure 52:
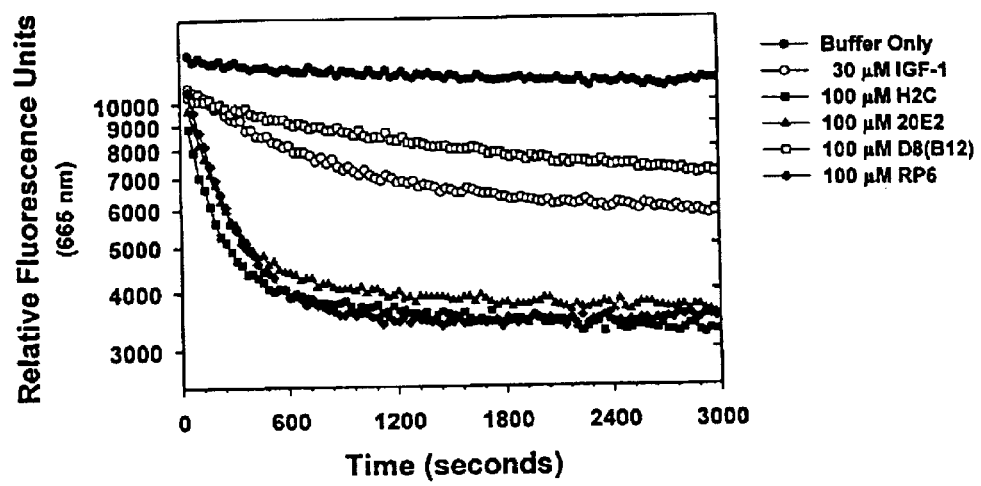

FIG. 52: Results of time-resolved fluorescence resonance energy transfer assays showing the effect of Site 1 peptide surrogates, Site 2 peptide surrogates, and rhIGF-1 on the dissociation of biotinylated-20E2 (b-20E2, Site 1) from recombinant human IGF-1R.

Figure 53:
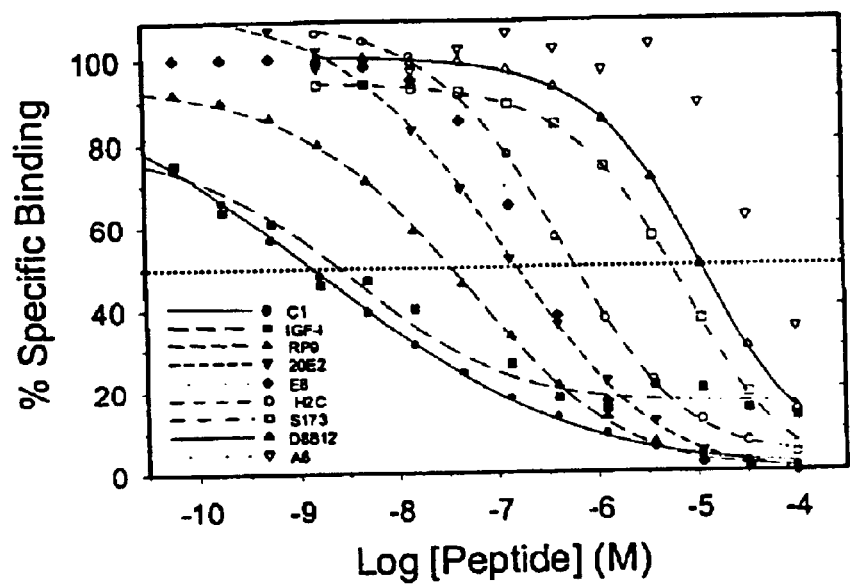

FIG. 53: Results of time-resolved fluorescence resonance energy transfer assays showing the effect of various peptide monomers and dimers on the dissociation of biotinylated-20E2 (b-20E2, Site 1) from recombinant human IGF-1R.

V. DETAILED DESCRIPTION OF THE INVENTION

This invention relates to amino acid sequences comprising motifs that bind to the insulin receptor (1R) and/or insulin-like growth factor receptor (IGF-1R). In addition to binding to IR and/or IGF-1R, the amino acid sequences also possess either agonist, partial agonist or antagonist activity at IR or IGF-1R. In addition, the amino acid sequences bind to separate binding sites (Sites 1 or 2) on IR or IGF-1R.

Although capable of binding to IR or IGF-1R at sites which participate in conferring agonist or antagonist activity, the amino acid sequences are not based on the native insulin or IGF-1 sequences, nor do they reflect an obvious homology to any such sequences.

The amino acid sequences of the invention may be peptides, polypeptides, or proteins. These terms as used herein should not be considered limiting with respect to the size of the various amino acid sequences referred to herein and which are encompassed within this invention. Thus, any amino acid sequence comprising at least one of the IR or IGF-1R binding motifs disclosed herein, and which binds to IR or IGF-1R is within the scope of this invention. In preferred embodiments, the amino acid sequences confer insulin or IGF-1 agonist or antagonist activity. The amino acid sequences of the invention are typically artificial, i.e., non-naturally occurring, peptides, or polypeptides. Amino acid sequences useful in the invention may be obtained through various means such as chemical synthesis, phage display, cleavage of proteins or polypeptides into fragments, or by any means which amino acid sequences of sufficient length to possess binding ability may be made or obtained.

The amino acid sequences provided by this invention should have an affinity for IR sufficient to provide adequate binding for the intended purpose. Thus, for use as a therapeutic, the peptide, polypeptide, or protein provided by this invention should have an affinity ($K_d$) of between about 10 to about $10^{-15}$ M. More preferably the affinity is 10 to about $10^{-12}$ M. Most preferably, the affinity is $10^{-10}$ to about $10^{-12}$ M. For use as a reagent in a competitive binding assay to identify other ligands, the amino acid sequence preferably has affinity for the receptor of between about $10^{-5}$ to about $10^{-12}$M.

The present invention describes several different binding motifs, which bind to active sites on IR or IGF-1R. The binding motifs are defined based on the analysis of several different amino acid sequences and analyzing the frequency that particular amino acids or types of amino acids occur at a particular position of the amino acid sequence as described in the related applications of Beasley et al. International Application PCT/US00/08528, filed Mar. 29, 2000, and Beasley et al., U.S. application Ser. No. 09/538,038, filed Mar. 29, 2000.

Also included within the scope of this invention are amino acid sequences containing substitutions, additions, or deletions based on the teachings disclosed herein and which bind to IR or IGF-1R with the same or altered affinity. For example, sequence tags (e.g., FLAG® tags) or amino acids, such as one or more lysines, can be added to the peptide sequences of the invention (e.g., at the N-terminal or C-terminal ends) as described in detail herein. Sequence tags can be used for peptide purification or localization. Lysines can be used to increase peptide solubility or to allow for biotinylation. Alternatively, amino acid residues located at the carboxy and amino terminal regions of the consensus motifs described below, which comprise sequence tags (e.g., FLAG® tags), or which contain amino acid residues that are not associated with a strong preference for a particular amino acid, may optionally be deleted providing for truncated sequences. Certain amino acids (e.g., C-terminal or N-terminal residues) such as lysine which promote the stability or biotinylation of the amino acids sequences may be deleted depending on the use of the sequence, as for example, expression of the sequence as part of a larger sequence which is soluble, or linked to a solid support.

Peptides that bind to IR or IGF-1R, and methods and kits for identifying such peptides, have been disclosed by Beasley et al., International Application PCT/US00/08528 filed Mar. 29, 2000 and Beasley et al., U.S. application Ser. No. 09/538,038 filed Mar. 29, 2000, which are incorporated by reference in their entirety.

A. Consensus Motifs

The following motifs have been identified as conferring binding activity to IR and/or IGF-1R:

1. $X_1X_2X_3X_4X_5$ (Formula 1; Group 1; the A6 motif) wherein $X_1$, $X_2$, $X_4$ and $X_5$ are aromatic amino acids, preferably, phenylalanine or tyrosine. Most preferably, $X_1$ and $X_5$ are phenylalanine and $X_2$ is tyrosine. $X_3$ may be any small polar amino acid, but is preferably selected from aspartic acid, glutamic acid, glycine, or serine, and is most preferably aspartic acid or glutamic acid. $X_4$ is most preferably tryptophan, tyrosine, or phenylalanine and most preferably tryptophan. Particularly preferred embodiments of the A6 motif are FYDWF (SEQ ID NO:1554) and FYEWF (SEQ ID NO:1555). The A6 motif possesses agonist activity at IGF-1R, but agonist or antagonist activity at IR depending on the identity of amino acids flanking A6. See FIG. 5A.

Amino acid sequences that comprise the A6 motif and possess agonist activity at IR, include but are not limited to, D117/H$_2$C: FHENFYDWFVRQVSKK (SEQ ID NO:1556); D117/H2 minus terminal lysines: FHENFYDWFVRQVS (SEQ ID NO:1557); RP9: GSLDESFYDWFERQLGKK (SEQ ID NO:1558); RP9 minus terminal lysines: GSLDESFYDWFERQLG (SEQ ID NO:1559); and S175: GRVDWLQRNANFYDWFVAELG (SEQ ID NO:1560). Preferred RP9 sequences include GLADEDFYEWFERQLR (SEQ ID NO:1561), GLADELFYEWFDRQLS (SEQ ID NO:1562), GQLDEDFYEWFDRQLS (SEQ ID NO:1563), GQLDEDFYAWFDRQLS (SEQ ID NO:1564), GFMDESFYEWFERQLR (SEQ ID NO:1565), GFWDESFYAWFERQLR (SEQ ID NO:1566), GFMDESFYAWFERQLR (SEQ ID NO:1567), and GFWDESFYEWFERQLR (SEQ ID NO:1568). Nonlimiting examples of Group 1 (Formula 1; A6) amino acid sequences are shown in FIGS. 1A–1O.

2. $X_6X_7X_8X_9X_{10}X_{11}X_{12}X_{13}$ (Formula 2, Group 3; the B6 motif) wherein $X_6$ and $X_7$ are aromatic amino acids, preferably, phenylalanine or tyrosine. Most preferably, $X_6$ is phenylalanine and $X_7$ is tyrosine. $X_8$, $X_9$, $X_{11}$, and $X_{12}$ may be any amino acid. $X_{10}$ and $X_{13}$ are hydrophobic amino acids, preferably leucine, isoleucine, phenylalanine, tryptophan or methionine, but more preferably leucine or isoleucine. $X_{10}$ is most preferably isoleucine for binding to IR and leucine for binding to IGF-1R. $X_{13}$ is most preferably leucine. Amino acid sequences of Formula 2 may function as an antagonist at the IGF-1R, or as an agonist at the IR. Preferred consensus sequences of the Formula 2 motif are F Y $X_8$ $X_9$ L $X_{11}$ $X_{12}$ L (SEQ ID NO:1569), F Y $X_8$ $X_9$ I $X_{11}$ $X_{12}$ L (SEQ ID NO:1570), F Y$X_8$A I $X_{11}$, $X_{12}$L (SEQ ID NO:1571), and F Y $X_8$Y F $X_{11}$ $X_{12}$ L (SEQ ID NO:1572).

Another Formula 2 motif for use with this invention comprises F Y $X_8$ Y F $X_{11}$ $X_{12}$ L (SEQ ID NO:1573) and is shown as Formula 2A ("NNRP") below: $X_{115}$ $X_{116}$ $X_{117}$ $X_{118}$ F Y $X_8$ Y F $X_{11}$ $X_{12}$ L $X_{119}$ $X_{120}$ $X_{121}$ $X_{122}$, (SEQ ID NO:1574) wherein $X_{115}$-$X_{118}$ and $X_{18}X_{118-X\,122}$ may be any amino acid which allows for binding to IR or IGF-1R. $X_{115}$ is preferably selected from the group consisting of tryptophan, glycine, aspartic acid, glutamic acid, and arginine. Aspartic acid, glutamic acid, glycine, and arginine are more preferred. Tryptophan is most preferred. The preference for tryptophan is based on its presence in clones at a frequency three to five fold higher than that expected over chance for a random substitution, whereas aspartic acid, glutamic acid and arginine are present about two fold over the frequency expected for random substitution.

$X_{116}$ preferably is an amino acid selected from the group consisting of aspartic acid, histidine, glycine, and asparagine. $X_{117}$ and $X_{118}$ are preferably glycine, aspartic acid, glutamic acid, asparagine, or alanine. More preferably $X_{117}$ is glycine, aspartic acid, glutamic acid and asparagine whereas $X_{118}$ is more preferably glycine, aspartic acid, glutamic acid or alanine. $X_8$ when present in the. Formula 2A motif is preferably arginine, glycine, glutamic acid, or serine. $X_{11}$ when present in the Formula 2A motif is preferably glutamic acid, asparagine, glutamine, or tryptophan, but most preferably glutamic acid. $X_{12}$ when present in the Formula 2A motif is preferably aspartic acid, glutamic acid, glycine, lysine or glutamine, but most preferably aspartic acid. $X_{119}$ is preferably glutamic acid, glycine, glutamine, aspartic acid or alanine, but most preferably glutamic acid. $X_{120}$ is preferably glutamic acid, aspartic acid, glycine or glutamine, but most preferably glutamic acid. $X_{121}$ is preferably tryptophan, tyrosine, glutamic acid, phenylalanine, histidine, or aspartic acid, but most preferably tryptophan or tyrosine. $X_{122}$ is preferably glutamic acid, aspartic acid or glycine; but most preferably glutamic acid. Preferred amino acid residue are identified based on their frequency in clones over two fold over that expected for a random event, whereas the more preferred sequences occur about 3–5 times as frequently as expected.

3. $X_{14}X_{15}X_{16}X_{17}X_{18}X_{19}X_{20}X_{21}$ (Formula 3, reverse B6, revB6), wherein $X_{14}$ and $X_{17}$ are hydrophobic amino acids; $X_{14}$, $X_{17}$ are preferably leucine, isoleucine, and valine, but most preferably leucine; $X_{15}$, $X_{16}$, $X_{18}$ and $X_{19}$ may be any amino acid; $X_{20}$ is an aromatic amino acid, preferably tyrosine or histidine, but most preferably tyrosine; and $X_{21}$ is an aromatic amino acid, but preferably phenylalanine or tyrosine, and most preferably phenylalanine. For use as an IGF-1R binding ligand, an aromatic amino acid is strongly preferred at $X_{18}$.

4. $X_{22}X_{23}X_{24}X_{25}X_{26}X_{27}X_{28}X_{29}X_{30}X_{31}X_{32}X_{33}X_{34}X_{35}X_{36}X_{37}X_{38}X_{39}X_{40}X_{41}$ (Formula 4; Group 7; the F8 motif) wherein $X_{22}$, $X_{25}$, $X_{26}$, $X_{28}$, $X_{29}$, $X_{30}$, $X_{33}$, $X_{34}$, $X_{35}$, $X_{36}$, $X_{37}$, $X_{38}$, $X_{40}$, and $X_{41}$ are any amino acid. $X_{35}$ and $X_{37}$ may be any amino acid when the F8 motif is used as an IR binding ligand or as a component of an IR binding ligand, however for use as an IGF-1R binding ligand, glycine is strongly preferred at $X_{37}$ and a hydrophobic amino acid, particularly, leucine, is preferred at $X_{35}$. $X_{23}$ is a hydrophobic amino acid. Methionine, valine, leucine or isoleucine are preferred amino acids for $X_{23}$, however, leucine which is most preferred for preparation of an IGF-1R binding ligand is especially preferred for preparation of an IR binding ligand. At least one cysteine is located at $X_{24}$ through $X_{27}$, and one at $X_{39}$ or $X_{40}$. Together the cysteines are capable of forming a cysteine cross-link to create a looped amino acid sequence. In addition, although a spacing of 14 amino acids in between the two cysteine residues is preferred, other spacings may also be used provided binding to IGF-LR or IR is maintained. Accordingly, other amino acids may be substituted for the cysteines at positions $X_{24}$ and $X_{39}$ if the cysteines occupy other positions.

In one embodiment, for example, the cysteine at position $X_{24}$ may occur at position $X_{27}$ which will produce a smaller loop provided that the cysteine is maintained at position $X_{39}$. These smaller looped peptides are described herein as Formula 5, infra. $X_{27}$ is any polar amino acid, but is preferably selected from glutamic acid, glutamine, aspartic acid, asparagine, or as discussed above cysteine. The presence of glutamic acid at position $X_{27}$ decreases binding to IR but has less of an effect on binding to IGF-1R. $X_{31}$ is any aromatic amino acid and $X_{32}$ is any small amino acid. For binding to IGF-1R, glycine or serine is preferred at position $X_{31}$, however, tryptophan is highly preferred for binding to IR. At position $X_{32}$, glycine is preferred for both IGF-1R and IR binding. $X_{36}$ is an aromatic amino acid. A preferred consensus sequence for F8 is $X_{22}$ LC $X_{25}$ $X_{26}$ E $X_{28}$ $X_{29}$ $X_{30}$ WG $X_{33}$ $X_{34}$ $X_{35}$ $X_{36}$ $X_{37}$×38 C $X_{40_{41}}$ (SEQ ID NO:1575) whereas the amino acids are defined above. A more preferred F8 sequence is HLCVLEELFWGASLFGYCSG ("F8"; SEQ ID NO:1576). Amino acid sequences comprising the F8 sequence motif preferably bind to IR over IGF-1R. FIGS. 2A–2E list nonlimiting examples of Formula 4 amino acid sequences.

5. $X_{42}X_{43}X_{44}X_{45}X_{46}X_{47}X_{48}X_{49}X_{50}X_{51}X_{52}X_{53}X_{54}X_{55}$ $X_{56}X_{57}X_{58}X_{59}X_{60}X_{61}$ (Formula 5; mini F8 motif) wherein $X_{42}$, $X_{43}$, $X_{44}$, $X_{45}$, $X_{53}$, $X_{55}$, $X_{56}$, $X_{58}$, $X_{60}$ and $X_{61}$ are any amino acid. $X_{43}$, $X_{46}$, $X_{49}$, $X_{50}$ and $X_{54}$ are hydrophobic amino acids, however, $X_{43}$ and $X_{46}$ are preferably leucine, whereas $X_{50}$ is preferably phenylalanine or tyrosine but most preferably phenylalanine. $X_{47}$ and $X_{59}$ are cysteines. $X_{48}$ is preferably a polar amino acid, i.e., aspartic acid or glutamic acid, but most preferably glutamic acid. Use of the small amino acid at position 54 may confer IGF-1R specificity. $X_{51}$, $X_{52}$, and $X_{57}$ are small amino acids, preferably glycine. A preferred consensus sequence for mini F8 is $X_{42}$ $X_{43}$ $X_{44}$ $X_{45}$ L C E $X_{49}$ F G G $X_{53}$ $X_{54}$×55 $X_{56}$ G $X_{58}$ C $X_{60}$ $X_{61}$ (SEQ ID NO:1577). Amino acid sequences comprising the sequence of Formula 5 preferably bind to IGF-1R or IR.

6. $X_{62}$ $X_{63}$ $X_{64}$ $X_{65}$ $X_{66}$ $X_{67}$ $X_{68}$ $X_{69}$ $X_{70}$ $X_{71}$ $X_{72}$ $X_{73}$ $X_{74}$ $X_{75}$ $X_{76}$ $X_{77}$ $X_{78}$ $X_{79}$ $X_{80}$ $X_{81}$ (Formula 6; Group 2; the D8 motif) wherein $X_{62}$, $X_{65}$, $X_{68}$, $X_{69}$, $X_{71}$, $X_{73}$, $X_{76}$, $X_{77}$, $X_{78}$, $X_{80}$ and $X_{81}$ may be any amino acid. $X_{66}$ may also be any amino acid, however, there is a strong preference for glutamic acid. Substitution of $X_{66}$ with glutamine or valine may result in attenuation of binding. $X_{63}$, $X_{70}$, and $X_{74}$ are hydrophobic amino acids. $X_{63}$ is preferably leucine, isoleucine, methionine, or valine, but most preferably leucine. $X_{70}$ and $X_{74}$ are preferably valine, isoleucine, leucine, or methionine. $X_{74}$ is most preferably valine. $X_{64}$ is a polar amino acid, more preferably aspartic acid or glutamic acid, and most preferably glutamic acid. $X_{67}$ and $X_{75}$ are aromatic amino acids. Whereas tryptophan is highly preferred at $X_{67}$ and $X_{75}$ is preferably tyrosine or tryptophan but most preferably tyrosine. $X_{72}$ and $X_{79}$ are cysteines that again are believed to form a loop which position amino acid may be altered by shifting the cysteines in the amino acid sequence. D8 is most useful as an amino acid sequence having a preference for binding to IR as only a few D8 sequences capable of binding to IGF-1R over background have been detected. A preferred sequence for binding to IR is $X_{62}$L $X_{64}X_{65}X_{66}$W $X_{68}X_{69}X_{70}X_7$, C $X_{73}X_{74}X_{75}X_{76}X_{77}X_{78}$C $X_{80}X_{81}$ (SEQ ID NO:1578). Examples of specific peptide sequences comprising this motif include D8: KWLDQEWAWVQCEVYGRGCPSKK (SEQ ID NO:1579); and D8 minus terminal lysines: KWLDQEWAWVQCEVYGRGCPS (SEQ ID NO: 1580). Preferred D8 monomer sequences include SLEEEWAQIQ-CEIYGRGCRY (SEQ ID NO:1581) and SLEEEWAQIQ-CEIWGRGCRY (SEQ ID NO:1582). Preferred D8 dimer sequences include SLEEEWAQIECEVYGRGCPS (SEQ ID NO:1583), and SLEEEWAQIECEVWGRGCPS (SEQ ID NO:1584). Nonlimiting examples of Group 2 (Formula 6; D8) amino acid sequences are shown in FIGS. 3A–3E.

7. H $X_{82}$, $X_{83}$, $X_{84}$ X&5 Xa6 Xa7 $X_{88}$ $X_{89}$ $X_{90}$ $X_{91}$ $X_{92}$ (Formula 7) wherein $X_{82}$ is proline or alanine but most preferably proline; $X_{83}$ is a small amino acid more preferably proline, serine or threonine and most preferably proline; $X_{84}$ is selected from leucine, serine or threonine but most preferably leucine; $X_{85}$ is a polar amino acid preferably glutamic acid, serine, lysine or asparagine but more preferably serine; $X_{85}$ may be any amino acid but is preferably a polar amino acid such as histidine, glutamic acid, aspartic acid, or glutamine; $X_{67}$ is an aliphatic amino acid preferably leucine, methionine or isoleucine and most preferably leucine; amino acid $X_{88}$, $X_{89}$ and $X_{90}$ may be any amino acids; $X_{91}$ is an aliphatic amino acid with a strong preference for leucine as is $X_{92}$. Phenylalanine may also be used at position 92. A preferred consensus sequence of Formula 7 is H P P L S $X_{86}$ L $X_{88}X_{89}$ $X_{90}$ L L (SEQ ID NO:1585). The Formula 7 motif binds to IR with little or no binding to IGF-1R.

8. Another sequence is $X_{104}$ $X_{105}$ $X_{106}$ $X_{107}$ $X_{108}$ $X_{109}$ $X_{110}$ $X_{111}$ $X_{112}$ $X_{113}$ $X_{114}$ (Formula 8) which comprises eleven amino acids wherein at least one, and preferably two of the amino acids of $X_{106}$ through $X_{111}$ are tryptophan. In addition, it is also preferred that when two tryptophan amino acids are present in the sequence they are separated by three amino acids, which are preferably, in sequential order proline, threonine and tyrosine with proline being adjacent to the tryptophan at the amino terminal end. Accordingly, the most preferred sequence for $X_{107}$ $X_{108}$ $X_{109}$ $X_{110}$ $X_{111}$ is WPTYW (SEQ ID NO:1586). At least one of the three amino acids on the amino terminal ($X_{104}$, $X_{105}$ $X_{106}$) and at least one of the amino acids carboxy terminal ($X_{112}$ $X_{113}$ $X_{14}$) ends immediately flanking $X_{107}$–$X_{111}$ are preferably a cysteine residue, most preferably at $X_{105}$ and $X_{113}$ respectively. Without being bound by theory, the cysteines are preferably spaced so as to allow for the formation of a loop structure. $X_{104}$ and $X_{114}$ are both small amino acids such as, for example, alanine and glycine. Most preferably, $X_{104}$ is alanine and $X_{114}$ is glycine. $X_{105}$ may be any amino acid but is preferably valine. $X_{112}$ is preferably asparagine. Thus, the most preferred sequence is ACVWPTYWNCG (SEQ ID NO:1587).

9. An amino acid sequence comprising JBA5: DYKDLCQSWGVRIGWLAGLCPKK (SEQ ID NO:1541); or JBA5 without terminal lysines: LCQSWGVRIGWLAGLCP (SEQ ID NO:1542) (Formula 9). The Formula 9 motif is another motif believed to form a cysteine loop that possesses agonist activity at both IR and IGF-1R. Although IR binding is not detectable by ELISA, binding of Formula 9 to IR is competed by insulin and is agonistic.

10. W $X_{123}$ G Y $X_{124}$ W $X_{125}$ $X_{126}$ (SEQ ID NO:1543) (Formula 10; Group 6) wherein $X_{123}$ is selected from proline, glycine, serine, arginine, alanine or leucine, but more preferably proline; $X_{124}$ is any amino acid, but preferably a charged or aromatic amino acid; $X_{125}$ is a hydrophobic amino acid preferably leucine or phenylalanine, and most preferably leucine. $X_{126}$ is any amino acid, but preferably a small amino acid. In one embodiment of the present invention, the Formula 10, Group 6 motif is WPGY (SEQ ID NO: 1588). Examples of specific peptide sequences comprising this motif include E8: KVRGFQGGTVWPGYEWLRNAAKK (SEQ ID NO:1589); and E8 minus terminal lysines: KVRGFQGGTVWPGYEWLRNM (SEQ ID NO:1590). Preferred Group 6 sequences include WAGYEWF (SEQ ID NO:1591), WEGYEWL (SEQ ID NO:1592), WAGYEWL (SEQ ID NO:1593), WEGYEWF (SEQ ID NO:1594), and DSDWAGYEWFEEQLD (SEQ ID NO:1595). Nonlimiting examples of Group 6 amino acid sequences are shown in FIGS. 4A–4B.

The IR and IGF-1R binding activities of representative Group 1 (Formula 1; A6); Group 2 (Formula 6; D8); and Group 6 (Formula 10); and Group 7 (Formula 4; F8) amino acid sequences are summarized in FIGS. 8 and 9A–9B. Group 1 (Formula 1: A6) amino acid sequences contain the consensus sequence FyxWF (SEQ ID NO:1596), which is typically agonistic in cell-based assays. Group 2 (Formula 6; D8) amino acid sequences are composed of two internal sequences having a consensus sequence VYGR (SEQ ID NO:1597) and two cysteine residues each. Thus, Group 2 peptides are capable of forming a cyclic peptide bridged with a disulfide bond. Neither of these consensus sequences have any significant linear sequence similarities greater than 2 or 3 amino acids with mature insulin. Group 7 (Formula 4; F8) amino acid sequences are composed of two internal exemplary sequences which do not have any significant sequence homology, but have two cysteine residues 13–14 residues apart, thus being capable of forming a cyclic peptide with a long loop anchored by a disulfide bridge.

B. Amino And Carboxyl Terminal Extensions Modulate Activity of Motifs

In addition to the motifs stated above, the invention also provides preferred sequences at the amino terminal or carboxyl terminal ends which are capable of enhancing binding of the motifs to either IR, IGF-1R, or both. In addition, the use of the extensions described below does not preclude the possible use of the motifs with other substitutions, additions or deletions that allow for binding to IR, IGF-1R, or both.

1. Formula 1

Any amino acid sequence may be used for extensions of the amino terminal end of A6, although certain amino acids in amino terminal extensions may be identified which modulate activity. Preferred carboxy terminal extensions for A6 are A6 $X_{93}$ $X_{94}$ $X_{95}$ $X_{96}$ $X_{97}$ wherein $X_{93}$ may be any amino acid, but is preferably selected from the group consisting of alanine, valine, aspartic acid, glutamic acid, and arginine, and $X_{94}$ and $X_{97}$ are any amino acid; $X_{95}$ is preferably glutamine, glutamic acid, alanine or lysine but most preferably glutamine. The presence of glutamic acid at $X_{95}$ however may confer some IR selectivity. Further, the failure to obtain sequences having an asparagine or aspartic acid at position $X_{95}$ may indicate that these amino acids should be avoided to maintain or enhance sufficient binding to IR and IGF-LR. $X_{96}$ is preferably a hydrophobic or aliphatic amino acid, more preferably leucine, isoleucine, valine, or tryptophan but most preferably leucine. Hydrophobic residues, especially tryptophan at $X_{96}$ may be used to enhance IR selectivity.

2. Formula 2

B6 with amino terminal and carboxy terminal extensions may be represented as $X_{98}$ $Xg_9$ B6 $X_{100}$. $X_{98}$ is optionally aspartic acid and $X_{99}$ is independently an amino acid selected from the group consisting of glycine, glutamine, and proline. The presence of an aspartic acid at $X_{98}$ and a proline at $X_{99}$ is associated with an enhancement of binding for both IR and IGF-1R. A hydrophobic amino acid is preferred for the amino acid at $X_{100}$, an aliphatic amino acid is more preferred. Most preferably leucine, for IR and valine for IGF-1R. Negatively charged amino acids are preferred at both the amino and carboxy terminals of Formula 2A.

3. Formula 3

An amino terminal extension of Formula 3 defined as $X_{101}$, $X_{102}$ $X_{103}$ revB6 wherein $X_{103}$ is a hydrophobic amino acid, preferably leucine, isoleucine or valine, and $X_{102}$ and $X_{101}$ are preferably polar amino acids, more preferably aspartic acid or glutamic acid may be useful for enhancing binding to IR and IGF-1R. No preference is apparent for the amino acids at the carboxy terminal end of Formula 3.

4. Formula 10

In one preferred embodiment, Formula 10 sequences W $X_{123}$ G Y $X_{124}$ W $X_{125}$ $X_{126}$ (SEQ ID NO:1543) can include an amino terminal extension comprising the sequence DSD and/or a carboxy terminal extension comprising the sequence EQLD (SEQ ID NO:1598).

C. IR Binding Preferences

As indicated above, the amino acid sequences containing the motifs of this invention may be constructed to have enhanced selectivity for either IR or IGF-R by choosing appropriate amino acids at specific positions of the motifs or the regions flanking them. By providing amino acid preferences for IR or IGF-1R, this invention provides the means for constructing amino acid sequences with minimized activity at the non-cognate receptor. For example, the amino acid sequences disclosed herein with high affinity and activity for IR and low affinity and activity for IGF-R are desirable as IR agonist as their propensity to promote undesirable cell proliferation, an activity of IGF-1 agonists, is reduced. Ratios of IR binding affinity to IGF-1R binding affinity for specific sequences are provided in FIGS. 1A–1O; 2A–2E; 3A–3E; 4A–4I; 44A–44B. As an insulin therapeutic, the IR/IGF-1R binding affinity ratio is preferably greater than 100. Conversely, for use as an IGF-1R therapeutic, the IR/IGF-1R ratio should be less than 0.01. Examples of peptides that selectively bind to IGF-1R are shown below.

TABLE 1

IGF-1R-SELECTIVE SEQUENCES

| Clone | SEQ ID NO: | Sequence | Ratios over Background | | | Comparisons | |
|---|---|---|---|---|---|---|---|
| | | | E-Tag | IGF-1R | IR | IGF-1R/IR | IR/IGF-1R |
| FORMULA 1 (Group 1; A6-like): | | | | | | | |
| A6L-0-E6-IR | 1599 | YRGMLVLGRSSDGAGKVAFERPARIGQTVFAVNFYDWFV | 31.0 | 31.0 | 1.8 | 17.0 | 0.1 |
| H2CA-4-G9-IGFR | 1600 | GIISQSCPESFYDWFAGQVSDPWWCW | 8.6 | 9.5 | 0.6 | 16.0 | 0.1 |
| H2CA-4-H6-IGFR | 1601 | VGRASGFPENFYDWFGRQLSLQSGEQ | 4.9 | 10.5 | 0.7 | 14.6 | 0.1 |
| A6L-0-E4-IR | 1602 | YRGMLVLGRISDGAG#VASEPPARIGRKVFAVNFYDWFV | 26.0 | 16.0 | 1.3 | 13.0 | 0.1 |
| A6L-0-H3-IR | 1603 | YRGMLVLGRISGGAGKAASERPARIGQKVSAVNFYDWFV | 27.0 | 26.0 | 2.0 | 13.0 | 0.1 |
| H2CA-4-F5-IGFR | 1604 | VGYQGQGDENFYDWFIRQVSGRLGVQ | 5.5 | 9.7 | 0.8 | 12.3 | 0.1 |
| H2CA-4-H8-IGFR | 1605 | SACQFDCHENFYDWFARQVSGGAAYG | 5.6 | 9.2 | 1.0 | 9.4 | 0.1 |
| H2CA-4-F11-IGFR | 1606 | SAAQLFFQESFYDWFLRQVAESSQPN | 3.5 | 6.8 | 1.0 | 6.7 | 0.1 |
| H2CA-4-F6-IGFR | 1607 | AVRATRFDEAFYDWFVRQISDGQGNK | 3.9 | 7.3 | 1.1 | 6.4 | 0.2 |
| H2CA-4-F10-IGFR | 1608 | VNQSGSIHENFYDWFERQVSHQRGVR | 4.9 | 5.7 | 1.0 | 5.9 | 0.2 |
| H2CA-1-A3-IGFR | 1609 | APDPSDFQEIFYDWFVRQVSRMPGGG | 7.7 | 3.8 | 0.8 | 5.1 | 0.2 |
| H2CA-3-C8-IGFR | 1610 | SSCDGAGHESFYEWFVRQVSGCRSV | 15.1 | 5.6 | 1.2 | 4.8 | 0.2 |
| H2CA-2-B9-IGFR | 1611 | RAGSSDFHEDFYEWFVRQVSLSLKGK | 9.3 | 7.0 | 1.7 | 4.2 | 0.2 |
| H2CA-4-H4-IGFR | 1612 | QAVQPGFHEEFYDWFVRQVSTGVGGG | 3.9 | 4.1 | 1.0 | 4.2 | 0.2 |
| E4Dα-4-H2-IR | 1613 | GFREGNFYEWFQAQVT | 37.8 | 33.9 | 8.2 | 4.1 | 0.2 |
| H2CA-4-F7-IGFR | 1614 | SSIGGGFHENFYDWFSRQLSQSPPLK | 1.5 | 3.2 | 0.8 | 4.1 | 0.2 |
| H2CA-3-D6-IGFR | 1615 | QSPVGSSHEDFYDWFFRQVAQSGAHQ | 8.3 | 9.0 | 2.2 | 4.0 | 0.3 |
| H2CA-3-D8-IGFR | 1616 | NYRRQVFNGNFYDWFDRQVFSLVTPG | 10.9 | 7.2 | 1.8 | 4.0 | 0.3 |
| H2CA-4-G11-IGFR | 1617 | TLDGGSFEEQFYDWFVRQLSYRTNPD | 10.8 | 9.5 | 2.5 | 3.9 | 0.3 |
| H2CA-4-F1-IGFR | 1618 | FYVQQWGHENFYDWFDRQVSQSGGAG | 5.8 | 3.5 | 0.9 | 3.8 | 0.3 |
| H2CA-3-D7-IGFR | 1619 | LRRQAPVEENFYDWFVRQVSGDRVGG | 13.3 | 3.0 | 0.8 | 3.7 | 0.3 |
| H2CA-1-A7-IGFR | 1620 | RCGRELYHSTFYDWFDRQVAGRTCPS | 8.0 | 2.2 | 0.6 | 3.7 | 0.3 |
| H2CA-2-B4-IGFR | 1621 | CCLLCRFQQNFYDWFVCQGISRLRPL | 3.5 | 4.1 | 1.1 | 3.6 | 0.3 |
| H2CA-2-B3-IGFR | 1622 | PPLASDLDVQFYGWFVQQVSPPGRGG | 7.7 | 3.8 | 1.0 | 3.6 | 0.3 |
| H2CA-2-B2-IGFR | 1623 | GAPVDQLHEDFYDWFVRQVSQAATG | 4.1 | 3.4 | 1.0 | 3.5 | 0.3 |
| E4Dα-2-D11-IR | 1624 | GFREGSFYDWFQAQVT | 40.2 | 11.1 | 3.3 | 3.4 | 0.3 |
| 20E2Bβ-4-G6-IR | 1625 | SQAGSAFYAWFDQVLRTVHSA | 22.4 | 6.2 | 1.9 | 3.3 | 0.3 |
| H2CA-4-H9-IGFR | 1626 | RGAVAGFHDQFYDWFDRQVSRVHKFG | 8.7 | 5.6 | 1.9 | 3.0 | 0.3 |
| H2CA-2-B11-IGFR | 1627 | AICDAGFHEHFYDWFALQVSDCGRQS | 11.9 | 4.6 | 1.6 | 3.0 | 0.3 |
| H2CA-3-E8-IGFR | 1628 | LGYQEPFQQNFYDWFVRQVSGAENAG | 13.2 | 6.3 | 2.2 | 2.9 | 0.3 |
| A6S-2-D11-IR | 1629 | EAASLGSQDRNFYDWFVRQVV | 48.4 | 37.4 | 13.5 | 2.8 | 0.4 |
| A6S-2-D1-IR | 1630 | VERSASSQDGNFYDWFVQIR | 37.8 | 30.6 | 12.0 | 2.6 | 0.4 |
| A6S-3-E2-IR | 1631 | TSEVQRRSQDNFYDWFVAQVA | 33.1 | 24.7 | 9.8 | 2.5 | 0.4 |
| H2CA-3-E11-IGFR | 1632 | HLADGQFHEKFYDWFERQISSRCNDC | 4.7 | 2.2 | 1.0 | 2.2 | 0.5 |
| H2CA-3-C11-IGFR | 1633 | FRTLAAQHDSFYDWFDRQVSGAAGER | 9.3 | 3.3 | 1.6 | 2.1 | 0.5 |
| A6-PD1-IGFR | 1634 | SFHEDFYDWFDRQVSGSLKK | | | | | |
| H2C-PD1-IGFR (RP9) | 1558 | GSLDESFYDWFERQLGKK | | | | | |
| FORMULA 2 (Group 2; B6-like): | | | | | | | |
| 20C-3-G3-IGFR | 1635 | TFYSCLASLLTGTPQPNRGPWERCR | 33.1 | 32.3 | 1.2 | 27.0 | <0.1 |
| 20C-4-C7-IGFR | 1636 | FFYDCLAALLQGVARYHDLCAVEIT | 35.3 | 28.0 | 1.3 | 21.8 | <0.1 |
| B6Hα-1-B5-IR | 1637 | CCTTEMVVMDARDDPFYHKLSELVTGG | 41.5 | 20.5 | 1.0 | 20.5 | 0.0 |
| R20β-4-A6-IR | 1638 | RGQSDAFYSGLWALIGLSDG | 9.3 | 25.9 | 1.5 | 17.3 | 0.1 |
| 20E2B-1-A6-IGFR | 1639 | GVRAMSFYDALVSVLGLGPSG | 18.6 | 18.1 | 1.1 | 16.8 | 0.1 |
| R20α-4-20A12-IR | 1640 | RLFYCGIQALGANLGYSGCV | 48.6 | 39.9 | 2.4 | 16.6 | 0.1 |
| 20E2Bβ-4-G7-IR | 1641 | LQPCSGFYECIERLIGVKLSG | 19.9 | 25.2 | 1.6 | 15.8 | 0.1 |
| NNRPγ-4-B11-IR | 1642 | LKDGFYDYFWQRLHLGS | 4.1 | 18.7 | 1.2 | 15.5 | 0.1 |
| 20E2B-3-C6-IGFR | 1643 | VEGRGLFYDLLRQLLARRQNG | 17.9 | 16.8 | 1.1 | 14.8 | 0.1 |
| B6Hα-1-A2-IR | 1644 | RGCNDDGGKGWSSDDPFYHKLSELICGG | 22.3 | 14.6 | 1.0 | 14.6 | 0.1 |
| 20E2A-4-F11-IGFR | 1645 | QGGSASFYDAIDRLLRMRIGG | 21.3 | 18.8 | 1.3 | 14.6 | 0.1 |
| B6Hα-3-E9-IR | 1646 | RCEEKQAEVGPSSDPFYHKMSELLGCR | 44.6 | 24.2 | 1.7 | 14.2 | 0.1 |
| 20C-3-F6-IGFR | 1647 | DRDFCRFYERLTALVGGQVDQGWPC | 33.5 | 26.1 | 1.9 | 14.1 | 0.1 |
| 20E2B-4-H3-IGFR | 1648 | KLHNLMFYYGLQRLVWGAGLG | 11.2 | 14.8 | 1.1 | 13.9 | 0.1 |
| 20E2B-3-C2-IGFR | 1649 | GWGDGMFYQLLSLLVGRDMHV | 13.1 | 8.9 | 0.6 | 13.8 | 0.1 |
| 20C-3-A1-IGFR | 1650 | SSYGCDGFYLMLFSLGLVASQELEC | 26.5 | 20.8 | 1.5 | 13.7 | 0.1 |
| 20E2B-3-E3-IGFR | 1651 | PDLHKGFYAQLAQLIRGQLLS | 22.4 | 16.3 | 1.3 | 13.1 | 0.1 |
| R20α-3-20E2-IR | 1652 | FYDAIDQLVRGSARAGGTRD | 46.3 | 39.9 | 3.1 | 12.9 | 0.1 |
| 20E2B-4-H12-IGFR | 1653 | YSCGDGFYSLLSDLLGGQFRC | 6.5 | 9.7 | 0.8 | 12.8 | 0.1 |
| B6Hα-3-F11-IR | 1654 | RGMKEEVLVGGSTDPFYHKLSELLQGS | 49.5 | 18.7 | 1.6 | 11.7 | 0.1 |
| 20E2B-3-D2-IGFR | 1655 | IQQELTFYDLLHRLVRSELGS | 20.7 | 12.4 | 1.1 | 11.7 | 0.1 |
| 20E2B-3-D8-IGFR | 1656 | GGTEVDFYRALERLVRGQLGL | 20.4 | 17.7 | 1.6 | 11.3 | 0.1 |
| 20E2B-3-E8-IGFR | 1657 | LRIANLFYQRLWDLAFGGGG | 15.7 | 16.7 | 1.5 | 11.1 | 0.1 |
| B6Hα-2-C4-IR | 1658 | RCGRW*AEMGAGDDPFYHKLSELVCG | 20.7 | 9.9 | 0.9 | 11.0 | 0.1 |
| R20α-4-20C11-IR | 1659 | DRAFYNGLRDLVGAVYGAWD | 43.7 | 30.8 | 3.0 | 10.3 | 0.1 |
| 20E2B-4-F8-IGFR | 1660 | PVGVQGFYEGLSRLVLGRGGW | 12.3 | 7.3 | 0.8 | 9.7 | 0.1 |
| 20E2B-1-A11-IGFR | 1661 | RFSTDGFYQYLLALVGGGPVG | 15.0 | 9.5 | 1.0 | 9.7 | 0.1 |
| 20E2B-3-D4-IGFR | 1662 | NSRDGGFYLQLERLLGFPVTG | 8.1 | 7.9 | 0.8 | 9.6 | 0.1 |
| 20E2B-2-B11-IGFR | 1663 | VVTPVNFYRALEALVRG.RLG | 13.9 | 10.6 | 1.1 | 9.4 | 0.1 |
| 20E2B-3-C8-IGFR | 1664 | QPAPDGFYSALMKLIGRGGVS | 18.5 | 15.6 | 1.8 | 8.9 | 0.1 |
| 20E2B-2-B2-IGFR | 1665 | PGTDLGFYQALRCVVIQGACD | 11.7 | 4.9 | 0.6 | 8.1 | 0.1 |

TABLE 1-continued

IGF-1R-SELECTIVE SEQUENCES

| Clone | SEQ ID NO: | Sequence | E-Tag | Ratios over Background IGF-1R | IR | Comparisons IGF-1R/IR | IR/IGF-1R |
|---|---|---|---|---|---|---|---|
| 20E2B-4-F10-IGFR | 1666 | AQPCGGFYGLLEQLVGRSVCD | 19.0 | 17.3 | 2.2 | 7.8 | 0.1 |
| 20E2B-4-F9-IGFR | 1667 | QPDHSYFYSLLQELVGSEERL | 11.9 | 14.7 | 1.9 | 7.7 | 0.1 |
| 20C-3-A4-IGFR | 1668 | QFYGCLLDLSLGVPSFGWRRRCITA | 17.7 | 8.8 | 1.2 | 7.6 | 0.1 |
| 20E2B-3-D11-IGFR | 1669 | LGVTDGFYAALGYLTHGVGQF | 14.3 | 12.2 | 1.6 | 7.6 | 0.1 |
| 20E2B-3-C11-IGFR | 1670 | CMM.DGFYAGLGCLLTAGEGR | 15.3 | 15.4 | 2.1 | 7.5 | 0.1 |
| 20E2B-2-B3-IGFR | 1671 | ICTGQGFYQVLCGLLRGTSAR | 9.1 | 5.3 | 0.7 | 7.4 | 0.1 |
| 20E2B-3-D12-IGFR | 1672 | QGNVLDFYGWIGRLLAKQGSD | 10.3 | 6.2 | 0.9 | 7.3 | 0.1 |
| 20E2B-3-E12-IGFR | 1673 | VATSQGFYSGLSELLQGGGNV | 13.9 | 6.0 | 0.8 | 7.3 | 0.1 |
| 20E2B-2-B8-IGFR | 1674 | IWATGDFYRLLSQLVMGRVGT | 17.4 | 5.7 | 0.8 | 7.2 | 0.1 |
| NNRPγ-4-A9-IR | 1675 | EGSGFYGYFFSLLGLQG | 3.0 | 10.0 | 1.4 | 7.1 | 0.1 |
| 20E2B-4-G11-IGFR | 1676 | RQGTGSFYLMLEQLLVGARGP | 8.9 | 4.5 | 0.6 | 7.0 | 0.1 |
| 20E2B-3-D6-IGFR | 1677 | DSVGDNFYQLLESLVGGHGVG | 20.7 | 17.8 | 2.6 | 6.9 | 0.1 |
| B6Hα-2-C7-IR | 1678 | RGIVAMVEATEVGSDHDPFYHKLSELVQGS | 45.1 | 6.7 | 1.0 | 6.7 | 0.1 |
| 20E2B-2-B7-IGFR | 1679 | LSSDGQFYRALNLLLQGSAGR | 18.0 | 6.1 | 0.9 | 6.7 | 0.1 |
| 20E2B-3-C4-IGFR | 1680 | ASSASGFYELLQRLAGLGLEV | 23.4 | 20.4 | 3.3 | 6.2 | 0.2 |
| 20C-3-E4-IGFR | 1681 | FFYRCLSRLLGGQLGSRLGLSCIGD | 37.7 | 7.7 | 1.3 | 6.0 | 0.2 |
| NNRPγ-4-A1-IR | 1682 | IIGGFYSYFNSVLRLGT | 9.7 | 10.9 | 1.8 | 6.0 | 0.2 |
| 20E2B-4-H8-IGFR | 1683 | PAGPCGFYCGLGLLLHGDQSP | 7.2 | 5.3 | 0.9 | 5.9 | 0.2 |
| 20E2B-4-H9-IGFR | 1684 | RCQGTGFYTCIQELIGFGDPD | 4.5 | 5.2 | 0.9 | 5.6 | 0.2 |
| B6Hα-2-C10-IR | 1685 | SGAKVIVVTGDSGDPFYHKLSELLQGS | 46.9 | 5.8 | 1.1 | 5.3 | 0.2 |
| 20E2A-3-C7-IGFR | 1686 | VGTVAGFYDAIAQLVARASRV | 17.6 | 5.4 | 1.1 | 5.1 | 0.2 |
| 20E2B-1-A8-IGFR | 1687 | TLRSPTFYDWLEMVLTHGQGG | 16.1 | 4.4 | 0.9 | 5.0 | 0.2 |
| NNRPγ-4-A7-IR | 1688 | RFDPFYSYFVNLLGASA | 2.5 | 6.3 | 1.3 | 4.9 | 0.2 |
| B6Hα-3-E8-IR | 1689 | RGKTAAVIVGRPADPFYHKLSELLQGG | 47.6 | 5.3 | 1.1 | 4.8 | 0.2 |
| B6Hα-3-F10-IR | 1690 | GCVVEWQKWHGASDPFYHKLSELGGCS | 47.2 | 8.8 | 1.9 | 4.6 | 0.2 |
| B6Hα-2-D6-IR | 1691 | GRTMAVMAAGGPDDPFYHKLSELVQGG | 33.5 | 4.4 | 1.0 | 4.4 | 0.2 |
| B6Hα-3-E7-IR | 1692 | GCAVVEEAERSRGDPFYHKLSELIQGC | 47.0 | 5.6 | 1.3 | 4.3 | 0.2 |
| B6Hα-2-D1-IR | 1693 | GCEVIVEEGDSADPFYEKLSELCQGS | 11.7 | 5.4 | 1.3 | 4.2 | 0.2 |
| 20E2A-3-D10-IGFR | 1694 | MMVVDGFYDALHQLVVAQSLG | 20.6 | 6.9 | 1.8 | 3.9 | 0.3 |
| 20E2A-3-A12-IGFR | 1695 | LSVALSFYDALGQLVAGEGRW | 16.1 | 4.3 | 1.1 | 3.9 | 0.3 |
| B6Hα-4-G8-IR | 1696 | GGTKAVAKVGTRDDPFYHKLSELLQGS | 32.3 | 6.1 | 1.7 | 3.6 | 0.3 |
| B6L-4-D7-IR | 1697 | AETSVQVGWIRLQSVWPGEHWNTVDPFYHKLSELLRGSGA | 14.3 | 4.8 | 1.4 | 3.4 | 0.3 |
| B6Hα-1-A3-IR | 1698 | SRAKVEAEMPDSGDPFYHKLSELLASG | 37.4 | 2.6 | 0.8 | 3.3 | 0.3 |
| B6Hα-3-F7-IR | 1699 | SRVAATKEKRPSDDPFYHKLSELLQGS | 41.5 | 3.1 | 1.0 | 3.1 | 0.3 |
| B6Hα-2-D8-IR | 1700 | SSETAKMVTGTRDDPFYHKLSELVQGS | 19.3 | 3.0 | 1.0 | 3.0 | 0.3 |
| B6Hα-1-B3-IR | 1701 | GCITAENGAGDPFYEKLSELGGCS | 33.1 | 3.2 | 1.1 | 2.9 | 0.3 |
| B6Hα-3-E5-IR | 1702 | RCGDEEGWQENRRDDPFYHKLSELFGGC | 28.8 | 2.9 | 1.0 | 2.9 | 0.3 |
| 20E2A-4-G11-IGFR | 1703 | MNVFVSFYDAIDQLVCQRIGC | 20.7 | 3.3 | 1.3 | 2.6 | 0.4 |
| 20E2Bβ-3-C7-IR | 1704 | QSGSGDFYDWLSRLIRGNGDG | 1.5 | 3.1 | 1.5 | 2.0 | 0.5 |
| B6Hα-3-E6-IR | 1705 | CGAKMTGTPNDPFYHKLSELLQRG | 18.2 | 2.3 | 1.2 | 1.9 | 0.5 |
| 20E2A-3-A3-IGFR | 1706 | GHYFGSFYDAIDQLVAGMLPG | 5.2 | 3.0 | 1.5 | 1.9 | 0.5 |
| B6L-4-A7-IR | 1707 | AGTPAQVG*NRLWSVWPGEHWNTVDPFYNKLSELLRESGA | 11.6 | 3.4 | 1.9 | 1.8 | 0.6 |
| B6Hα-3-F1-IR | 1708 | CSMAAVEAAGDDDDPFYHKLSELCQGS | 22.5 | 2.4 | 1.3 | 1.8 | 0.5 |
| B6L-3-G6-IR | 1709 | VDTPAQVGWNRLWSVGPGEHWYTDDPFYH*LSELLRESGA | 7.6 | 2.5 | 1.8 | 1.4 | 0.7 |
| B6L-3-G5-IR | 1710 | AETSAQVGWQRLWSVWPGDHWSTLDPFYHKLSELLRESGA | 11.5 | 2.0 | 1.4 | 1.4 | 0.7 |
| 20E2A-3-A4-IGFR | 1711 | AGSVTSFYDAMEQLVATGTSA | 16.8 | 2.5 | 1.8 | 1.4 | 0.7 |
| B6-PD1-IGFR | 1712 | TDDGFYDALEQLVQGSKK | | | | | |
| 20E2-PD1-IGFR (RP10) | 1713 | GSFYEALQRLVGGEQGKK | | | | | |
| FORMULA 10 (Group 6): | | | | | | | |
| R20β-4-E8-IR | 1714 | VRGFQCGTVWPGYEWLRNAA | 41.0 | 34.9 | 3.6 | 9.7 | 0.1 |
| 40F-4-D1-IGFR | 1715 | LSCLAYSRHGIWRPSTDLGLGRSVGEGSVSTRWRGYDWFE | 4.9 | 4.6 | 0.3 | 13.1 | 0.1 |
| 40F-4-B1-IGFR | 1716 | GLDHSDAVGVHLGFAWPAQARGRWEAGGLEDTWAGYDWL | 4.1 | 3.0 | 0.2 | 13.1 | 0.1 |
| 40F-4-D10-IGFR | 1717 | W.GYAWLS | 4.9 | 4.5 | 0.4 | 11.7 | 0.1 |

Besides relative binding at IR or IGF-1R, relative efficacy at the cognate receptor is another important consideration for choosing a potential therapeutic. Thus, a sequence that is efficacious at IR but has little or no significant activity at IGF-1R may also be considered as an important IR therapeutic, irrespective of the relative binding affinities at IR and IGF-1R. For example, A6 selectivity for IR may be enhanced by including glutamic acid in a carboxyl terminal extension at position $X_{95}$. IR selectivity of the B6 motif may be enhanced by having a tryptophan or phenylalanine at $X_{13}$. Tryptophan at $X_{13}$ also favors selectivity of IR. A tryptophan amino acid at $X_{13}$ rather than leucine at that position also may be used to enhance selectivity for IR. In the reverse B6 motif, a large amino acid at $X_{15}$ favors IR selectivity. Conversely, small amino acids may confer specificity for IGF-1R. In the F8 motif, an L in position $X_{23}$ is essentially required for IR binding. In addition, tryptophan at $X_{31}$ is also highly preferred. At $X_{32}$, glycine is preferred for IR selectivity.

D. Multiple Binding Sites On IR And IGF-1R

The competition data disclosed herein reveals that at least two separate binding sites are present on IR and IGF-R which recognize the different sequence motifs provided by this invention.

As shown in FIG. 6, competition data indicate that peptides comprising the A6 motifs compete for binding to the same site on IR (Site 1) whereas the D8 motifs compete for a second site (Site 2). The identification of peptides that bind to separate binding sites on IR and IGF-1R provides for various schemes of binding to IR or IGF-R to increase or decrease its activity. Examples of such schemes for IR are illustrated in FIG. 7.

The table below shows sequences based on their groups, which bind to Site 1 or Site 2.

TABLE 2

| Clone | Sequence | SEQ ID NO: |
|---|---|---|
| REPRESENTATIVE SITE 1 PEPTIDES | | |
| A6-like (FYxWF) (SEQ ID NO: 1596): | | |
| G3 | KRGGGTFYEWFESALRKHGAGKK | 1718 |
| H2 | VTFTSAVFHENFYDWFVRQVSKK | 1719 |
| H2C | FHKNFYDWFVRQVSKK | 1556 |
| A6S-IR3-E12 | GRVDWLQRNANFYDWFVAELG | 1560 |
| A6S-IR4-G1 | NGVERAGTGDNFYDWFVAQLH | 1720 |
| H2CB-R3-B12 | QSDSGTVHDRFYGWFRDTWAS | 1721 |
| 20E2A-R3-B11 | GRFYGWFQDAIDQLMPWGFDP | 1722 |
| rB6-F6 | RYGRWGLAQQFYDWFDR | 1723 |
| E4Dα-1-B8-IR~ | GFREGQRWYWFVAQVT | 1724 |
| H2CA-4-F11-IR | TYKARFLHENFYDWFNRQVSQYFGRV | 1725 |
| H2CB-R3-D2 | WTDVDGFHSGFYRWFQNQWER | 1726 |
| H2CB-R3-D12 | VASGHVLHGQFYRWFVDQFAL | 1727 |
| H2CB-R4-H5 | QARVGNVHQQFYEWFREVMQG | 1728 |
| H2C-B-E8* | TGHRLGLDEQFYWWFRDALSG | 1729 |
| H2CB-3-B6-IR~ | VGDFCVSHDCFYGWFLRESMQ | 1730 |
| A6S-IR2-C1 | RMYFSTGAPQNFYDWFVQEWD | 1731 |
| B6-like (FYxxLxxL) (SEQ ID NO: 1732): | | |
| 20C11 | KDRAFYNGLRDLVGAVYGAWDKK | 1733 |
| 20E2 | DYKDFYDAIDQLVRGSARAGGTRDKK | 1734 |
| B62-R3-C7 | EHWNTVDPFYFTLFEWLRESG | 1735 |
| B62-R3-C10 | EHWNTVDPFYQYFSELLRESG | 1736 |
| 20E2B-3-B3-IR | AGVNAGFYRYFSTLLDWWDQG | 1737 |
| 20E2-B-E3* | IQGWEPFYGWFDDVVAQMFEE | 1738 |
| 20E2A-R4-F9 | PPWGARFYDAIEQLVFDNLCC | 1739 |
| RPNN-4-G6-HOLO* | RWPNFYGYFESLLTHFS | 1740 |
| RPNN-4-F3-HOLO* | HYNAFYEYFQVLLAETW | 1741 |
| 20E2A-R4-E2 | IGRVRSFYDAIDKLFQSDWER | 1742 |
| RPNN-2-C1-IR* | EGWDFYSYFSGLLASVT | 1743 |
| 20E2B-4-F12-IR | SVKEVQFYRYFYDLLQSEESG | 1744 |
| 20E2-B-E12 | GNSGGSFYRYFQLLLDSDGMS | 1745 |
| 20E2A-R3-B6 | RDAGSSFYDAIDQLVCLTYFC | 1746 |
| Reverse B6-like (LxxLxxYF) (SEQ ID NO: 1747): | | |
| rB6-A12 | LDALDRLMRYFEERPSL | 1748 |
| rB6-F9 | PLAELWAYFEHSEQGRSSAH | 1749 |
| rB6-4-E7-IR | LDPLDALLQYFWSVPGH | 1750 |
| rB6-4-F9-IR | RGRLGSLSTQFYNWFAE | 1751 |
| rB6-E6 | ADELEWLLDYFMHQPRP | 1752 |
| rB6-4-F12-IR | DGVLEELFSYFSATVGP | 1753 |
| Group 6 (WPxYxWL) (SEQ ID NO: 1754): | | |
| R20β-4-A4-IR | WPGYLFFEEALQDWRGSTED | 1755 |
| Peptides by d sign**: | | |
| H2C-PD1-IR~ | AAVHEQFYDWFADQYKK | 1756 |
| A6S-PD1-IR~ | QAPSNFYDWFVREWDKK | 1757 |
| 20E2-PD1-IR~ | QSFYDYIEELLGGEWKK | 1758 |
| B6C-PD1-IR~ | DPFYQGLWEWLRESGKK | 1759 |
| REPRESENTATIVE SITE 2 PEPTIDES (C-C LOOPS) | | |
| F8-derived (Long C-C loop): | | |
| F8 | HLCVLEELFWGASLFGYCSG | 1760 |
| F8-C12 | FQSLLEELVWGAPLFRYGTG | 1761 |
| F8-Des2 | PLCVLEELFWGASLFGYCSG | 1762 |
| F8-F12 | PLCVLEELFWGASLFGQCSG | 1763 |
| F8-B9 | HLCVLEELFWGASLFGQCSG | 1764 |
| F8-B12 | DLRVLCELFGGAYVLGYCSE | 1765 |
| NNKH-2B3 | HRSVLKQLSWGASLFGQWAG | 1766 |
| NNKH-2F9~ | HLSVGEELSWWVALLGQWAR | 1767 |
| NNKH-4H4~ | APVSTEELRWGALLFGQWAG | 1768 |
| D8-derived (Small C-C loop): | | |
| D8 | KWLDQEWAWVQCEVYGRGCPSKK | 1769 |
| D8-G1 | QLEEEWAGVQCEVYGRECPS | 1770 |
| D8-B5~ | ALEEEWAWVQVRSIRSGLPL | 1771 |
| D8-A7 | SLDQEWAWVQCEVYGRGCLS | 1772 |
| D8-F1~ | WLEHEWAQIQCELYGRGCTY | 1773 |
| Midi C-C loop: | | |
| D8-F10 | GLEQGCPWVGLEVQCRGCPS | 1774 |
| F8-B12~ | DLRVLCELFGGAYVLGYCSE | 1775 |
| F8-A9 | PLWGLCELFGGASLFGYCSS | 1776 |

**Based on analysis of entire panning data, amino acid preferences at each position were calculated to define these "idealized" peptides;
*Peptides synthesized and currently being purified;
~Peptides planned.

In various aspects of the present invention, amino acid sequences comprising Site 1 motifs may bind to Site 1 of IR or Site 1 of IGF-1R. Similarly, amino acids sequences comprising Site 2 motifs may bind to Site 2 of IR or Site 2 of IGF-R. However, specific peptides may show higher binding affinity for IR than for IGF-1R, while other peptides may show higher binding affinity for IGF-IR than for IR. In addition, Site 1 and Site 2 on IR do not "crosstalk", i.e., Site 1-binding sequences do not compete with Site 2-binding sequences at IR. In contrast, Site I and Site 2 on IGF-1R do show some crosstalk, suggesting an allosteric effect. These aspects are illustrated in the Examples described hereinbelow.

E. Multivalent Ligands

This invention provides ligands that preferentially bind different sites on IR and IGF-1R. The A6 amino acid sequence motif confers binding to IR at Site 1 (FIG. 6). The D8 amino acid sequence motif confers binding to IR at Site 2 (FIG. 6). Accordingly, multimeric ligands may be prepared according to the invention by covalently linking amino acid sequences. Depending on the purpose intended for the multivalent ligand, amino acid sequences that bind the same or different sites may be combined to form a single molecule. Where the multivalent ligand is constructed to bind to the same corresponding site on different receptors, or different subunits of a receptor, the amino acid sequences of the ligand for binding to the receptors may be the same or different, provided that if different amino acid sequences are used, they both bind to the same site.

Multivalent ligands may be prepared by either expressing amino acid sequences which bind to the individual sites separately and then covalently linking them together, or by expressing the multivalent ligand as a single amino acid sequence which comprises within it the combination of specific amino acid sequences for binding.

Various combinations of amino acid sequences may be combined to produce multivalent ligands having specific desirable properties. Thus, agonists may be combined with agonists, antagonists combined with antagonists, and agonists combined with antagonists. Combining amino acid sequences that bind to the same site to form a multivalent ligand may be useful to produce molecules that are capable of cross-linking together multiple receptor units. Multivalent ligands may also be constructed to combine amino acid sequences which bind to different sites (FIG. 7).

In view of the discovery disclosed herein of monomers having agonist properties at IR or IGF-1R, preparation of multivalent ligands may be useful to prepare ligands having more desirable pharmacokinetic properties due to the presence of multiple bind sites on a single molecule. In addition, combining amino acid sequences that bind to different sites with different affinities provides a means for modulating the overall potency and affinity of the ligand for IR or IGF-1R.

1. Construction of Hybrids

In one embodiment, hybrids of at least two peptides (e.g., dimer peptides) may be produced as recombinant fusion polypeptides, which are expressed in any suitable expression system. The polypeptides may bind the receptor as either fusion constnrcts containing amino acid sequences besides the ligand binding sequences or as cleaved proteins from which signal sequences or other sequences unrelated to ligand binding are removed. Sequences for facilitating purification of the fusion protein may also be expressed as part of the construct. Such sequences optionally may be subsequently removed to produce the mature binding ligand. Recombinant expression also provides means for producing large quantities of ligand. In addition, recombinant expression may be used to express different combinations of amino acid sequences and to vary the orientation of their combination, i.e., amino to carboxyl terminal orientation.

In one embodiment shown below (FIG. 28), MBP-FLAGS PEPTIDE-(GGS), (SEQ ID NO: 1777)—PEPTIDE-E-TAG, a fusion construct producing a peptide dimer comprises a maltose binding protein amino acid sequence (MBP) or similar sequence useful for enabling the affinity chromatography purification of the expressed peptide sequences. This purification facilitating sequence may then be attached to a FLAG® sequence to provide a cleavage site to remove the initial sequence. The dimer then follows which includes the intervening linker and a tag sequence may be included at the carboxyl terminal portion to facilitate identification/purification of the expression of peptide. In the representative construct illustrated above, G and S are glycine and serine residues, which make up the linker sequence. As non-limiting examples, n can be 1, 2, 3, or 4 to yield a linker sequence of 3, 6, 9, and 12 amino acids, respectively.

In addition to producing the dimer peptides by recombinant protein expression, dimer peptides may also be produced by peptide synthesis whereby a synthetic technique such as Merrifield synthesis (Merrifield, 1997), may be used to construct the entire peptide.

Other methods of constructing dimer peptides include introducing a linker molecule that activates the terminal end of a peptide so that it can covalently bind to a second peptide. Examples of such linkers include, but are not limited to, diaminoproprionic acid activated with an oxyamino function. A preferred linker is a dialdehyde having the formula O=CH—(CH$_2$)$_n$—CH=O, wherein n is at least 2 to 6, but is preferably 6 to produce a linker of about 25 to 30 angstroms in length. Other preferred linkers are shown in Table 3. Linkers may be used, for example, to couple monomers at either the carboxyl terminal or the amino terminal ends to form dimer peptides. Also, the chemistry can be inverted, i.e., the peptides to be coupled can be equipped with aldehyde functions, either by oxidation with sodium periodate of an N-terminal serine, or by oxidation of any other vicinal hydroxy- or amino-groups, and the linker can comprise two oxyamino functions (e.g., at end of a polyethylene glycoi linker) or amino groups which are coupled by reductive amination.

In specific embodiments. Site 1-Site 2 and Site 2-Site 1 orientations are possible. In addition, N-terminal to N-terminal (N—N); C-terminal to C-terminal (C—C); N-terminal to C-terminal (N—C); and C-terminal to N-terminal (C—N) linkages are possible. Accordingly, peptides may be oriented Site 1 to Site 2, or Site 2 to Site 1, and may be linked N-terminus to N-terminus, C-terminus to C-terminus, N-terminus to C-terminus, or Cerminus to N-terminus. In certain cases, a specific orientation may be preferable to others, for example, for maximal agonist or antagonist activity.

In an unexpected and surprising result, the orientation and linkage of the monomer subunits has been found to dramatically alter dimer activity (see Examples, below). In particular, certain Site 1/Site 2 heterodimer sequences show agonist or antagonist activity at IR, depending on orientation and linkage of the constituent monomer subunits. For example, a Site 1-Site 2 orientation (C—N linkage), e.g., the S453 heterodimer, shows antagonist activity at IR (FIG. 18A; Table 7). In contrast, a Site 2-Site 1 orientation (C—N linkage), e.g., the S455 heterodimer, shows potent agonist activity at IR (FIG. 18D; Table 7). Similarly, Site 1-Site 2 (C—N linkage) heterodimers, e.g., S425 and S459, show antagonist activity at IR (Table 7), while Site 1-Site 2 (C—C or N—N linkage) heterodimers, e.g., S432–S438, S454, and S456, show agonist activity (Table 7).

Whether produced by recombinant gene expression or by conventional chemical linkage technology, the various amino acid sequences may be coupled through linkers of various lengths. Where linked sequences are expressed recombinantly, and based on an average amino acid length of about 4 angstroms, the linkers for connecting the two amino acid sequences would typically range from about 3 to about 12 amino acids corresponding to from about 12 to about 48 Å. Accordingly, the preferred distance between binding sequences is from about 2 to about 50 Å. More preferred is 4 to about 40. The degree of flexibility of the linker between the amino acid sequences may be modulated by the choice of amino acids used to construct the linker. The combination of glycine and serine is useful for producing a flexible, relatively unrestrictive linker. A more rigid linker may be constructed by using amino acids with more complex side chains within the linkage sequence.

2. Characterization Of Specific Dimers

Specific dimers which are comprised of monomer subunits that both bind with high affinity to the same site on IR (i.e., homodimers), or monomer subunits that bind to different sites on IR (i.e., heterodimers) are disclosed herein.

Other combinations of peptides are within the scope of this invention and may be determined as demonstrated in the examples described herein.

F. Peptide Synthesis

Many conventional techniques in molecular biology, protein biochemistry, and immunology may be used to produce the amino acid sequences for use with this invention. The present invention encompasses the specific amino acid sequences shown in FIGS. 1-4, 8, and 9 and Table 7., inter alia, without additions (e.g., linker or spacer sequences) deletions, alterations, or modification. The present invention further encompasses variants that include additional sequences, altered sequences, and functional fragments thereof. In a preferred embodiment, the amino acid sequence variant or fragment shares at least one function characteristic (e.g., binding, agonist, or antagonist activity) of the reference sequence. Variant peptides include, for example, genetically engineered mutants, and may differ from the amino acid sequences shown in the figures and tables of the application by the addition, deletion, or substitution of one or more amino acid residues. Alterations may occur at the amino- or carboxy-terminal positions of the reference amino acid sequence or anywhere between those terminal positions, interspersed either individually among the amino acids in the reference sequence or in one or more contiguous groups within the reference sequence. In addition, variants may comprise synthetic or non-naturally occurring amino acids in accordance with this invention.

Variant amino acid sequences can have conservative changes, wherein a substituted amino acid has similar structural or chemical properties, e.g., replacement of leucine with isoleucine. More infrequently, a variant peptide can have non-conservative changes, e.g., substitution of a glycine with a tryptophan. Guidance in determining which amino acid residues can be substituted, inserted, or deleted without abolishing binding or biological activity can be found using computer programs well known in the art, for example, DNASTAR software (DNASTAR, Inc., Madison, Wis.). Guidance is also provided by the data disclosed herein. In particular, FIGS. 1–4, 8, 9, 43, 44, and Table 7, inter alia, teach which amino acid residues can be deleted, added, substituted, or modified, while maintaining the IR— or IGF-1R-related function(s) (e.g., binding, agonist, or antagonist activity) of the amino acid sequences.

For the purposes of this invention, the amino acids are grouped as follows: amino acids possessing alcohol groups are serine (S) and threonine (T). Aliphatic amino acids are isoleucine (I), leucine (L), valine (V), and methionine (M). Aromatic amino acids are phenylalanine (F), histidine (H), tryptophan (W), and tyrosine (Y). Hydrophobic amino acids are alanine (A), cysteine (C), phenylalanine (F), glycine (G), histidine (H), isoleucine (I), leucine (L), methionine (M), arginine (R), threonine (T), valine (V), tryptophan (W), and tyrosine (Y). Negative amino acids are aspartic acid (D) and glutamic acid (E). The following amino acids are polar amino acids: cysteine (C), aspartic acid (D), glutamic acid (E), histidine (H), lysine (K), asparagine (N), glutamine (Q), arginine (R), serine (S), and threonine (T). Positive amino acids are histidine (H), lysine (K), and arginine (R). Small amino acids are alanine (A), cysteine (C), aspartic acid (D), glycine (G), asparagine (N), proline (P), serine (S), threonine (T), and valine (V). Very small amino acids are alanine (A), glycine (G) and serine (S). Amino acids likely to be involved in a turn formation are alanine (A), cysteine (C), aspartic acid (D), glutamic acid (E), glycine (G), histidine (H), lysine (K), asparagine (N), glutamine (Q), arginine (R), serine (S), proline (P), and threonine (T). As non-limiting examples, the amino acids within each of these defined groups may be substituted for each other in the formulas described above, as conservative substitutions, subject to the specific preferences stated herein.

Substantial changes in function can be made by selecting substitutions that are less conservative than those shown in the defined groups, above. For example, non-conservative substitutions can be made which more significantly affect the structure of the peptide in the area of the alteration, for example, the alpha-helical, or beta-sheet structure; the charge or hydrophobicity of the molecule at the target site; or the bulk of the side chain. The substitutions which generally are expected to produce the greatest changes in the peptide's properties are those where 1) a hydrophilic residue, e.g., seryl or threonyl, is substituted for (or by) a hydrophobic residue, e.g., leucyl, isoleucyl, phenylalanyl, valyl, or alanyl; 2) a cysteine or proline is substituted for (or by) any other residue; 3) a residue having an electropositive side chain, e.g., lysyl, arginyl, or histidyl, is substituted for (or by) an electronegative residue, e.g., glutamyl or aspartyl; or 4) a residue having a bulky side chain, e.g., phenylalanine, is substituted for (or by) a residue that does not have a side chain, e.g., glycine.

Amino acid preferences have been identified for certain peptides and peptide groups of the present invention. For example, amino acid preferences for the RP9, D8, and Group 6 (Formula 10) peptides are shown in Tables 17–19, below.

Variants also include amino acid sequences in which one or more residues are modified (i.e., by phosphorylation, sulfation, acylation, PEGylation, etc.), and mutants comprising one or more modified residues. Amino acid sequences may also be modified with a label capable of providing a detectable signal, either directly or indirectly, including, but not limited to, radioisotope, fluorescent, and enzyme labels. Fluorescent labels include, for example, Cy3, Cy5, Alexa, BODIPY, fluorescein (e.g., Fluor X, DTAF, and FITC), rhodamine (e.g., TRITC), auramine, Texas Red, AMCA blue, and Lucifer Yellow. Preferred isotope labels include $^3$H, $^{14}$C, $^{32}$P, $^{35}$S, $^{36}$Cl, $^{51}$Cr, $^{57}$Co, $^{58}$Co, $^{59}$Fe, $^{90}$Y, $^{125}$I, $^{131}$I, and $^{186}$Re. Preferred enzyme labels include peroxidase, $\beta$-glucuronidase, $\beta$-D-glucosidase, $\beta$D-galactosidase, urease, glucose oxidase plus peroxidase, and alkaline phosphatase (see, e.g., U.S. Pat. Nos. 3,654,090; 3,850,752 and 4,016,043). Enzymes can be conjugated by reaction with bridging molecules such as carbodiimides, diisocyanates, glutaraldehyde, and the like. Enzyme labels can be detected visually, or measured by calorimetric, spectrophotometric, fluorospectrophotometric, amperometric, or gasometric techniques. Other labeling systems, such as avidin/biotin, Tyramide Signal Amplification (TSA™), are known in the art, and are commerdally available (see, e.g., ABC kit, Vector Laboratories, Inc., Burlingame, Calif.; NEN® Life Science Products, Inc., Boston, Mass.).

1. Recombinant Synthesis of Peptides

To obtain recombinant peptides, DNA sequences encoding these peptides may be cloned into any suitable vectors for expression in intact host cells or in cell-free translation systems by methods well known in the art (see Sambrook et al., 1989). The particular choice of the vector, host, or translation system is not critical to the practice of the invention.

A large number of vectors, including bacterial, yeast, and mammalian vectors, have been described for replication and/or expression in various host cells or cell-free systems, and may be used for gene therapy as well as for simple cloning or protein expression. In one aspect of the present invention, an expression vector comprises a nucleic acid encoding a IR or IGF-1R agonist or antagonist peptide, as described herein, operably linked to at least one regulatory sequence. Regulatory sequences are known in the art and are selected to direct expression of the desired protein in an appropriate host cell. Accordingly, the term regulatory sequence includes promoters, enhancers and other expression control elements (see D. V. Goeddel (1990) Methods Enzymol. 185:3–7). Enhancer and other expression control sequences are described in Enhancers and Eukaryotic Gene Expression, Cold Spring Harbor Press, Cold Spring Harbor, N.Y. (1983). It should be understood that the design of the expression vector may depend on such factors as the choice of the host cell to be transfected and/or the type of peptide desired to be expressed.

Several regulatory elements (e.g., promoters) have been isolated and shown to be effective in the transcription and translation of heterologous proteins in the various hosts. Such regulatory regions, methods of isolation, manner of manipulation, etc. are known in the art. Non-limiting examples of bacterial promoters include the β-lactamase (penicillinase) promoter; lactose promoter; tryptophan (trp) promoter; araBAD (arabinose) operon promoter; lambda-derived $P_1$ promoter and N gene ribosome binding site; and the hybrid tac promoter derived from sequences of the trp and lac UV5 promoters. Non-limiting examples of yeast promoters include the 3-phosphoglycerate kinase promoter, glyceraldehyde-3-phosphate dehydrogenase (GAPDH) promoter, galactokinase (GALL1) promoter, galactoepimerase promoter, and alcohol dehydrogenase (ADH1) promoter. Suitable promoters for mammalian cells include, without limitation, viral promoters, such as those from Simian Virus 40 (SV40), Rous sarcoma virus (RSV), adenovirus (ADV), and bovine papilloma virus (BPV). Preferred replication and inheritance systems include M13, ColE1, SV40, baculovirus, lambda, adenovirus, CEN ARS, 2 μm ARS and the like. While expression vectors may replicate autonomously, they may also replicate by being inserted into the genome of the host cell, by methods well known in the art.

To obtain expression in eukaryotic cells, terminator sequences, polyadenylation sequences, and enhancer sequences that modulate gene expression may be required. Sequences that cause amplification of the gene may also be desirable. Furthermore, sequences that facilitate secretion of the recombinant product from cells, including, but not limited to, bacteria, yeast, and animal cells, such as secretory signal sequences and/or preprotein or proprotein sequences, may also be included. These sequences are well described in the art. DNA sequences can be optimized, if desired, for more efficient expression in a given host organism or expression system. For example, codons can be altered to conform to the preferred codon usage in a given host cell or cell-free translation system using well-established techniques.

Codon usage data can be obtained from publicly-available sources, for example, the Codon Usage Database at http://www.kazusa.or.jp/codon/. In addition, computer programs that translate amino acid sequence information into nucleotide sequence information in accordance with codon preferences (i.e., backtranslation programs) are widely available. See, for example, Backtranslate program from Genetics Computer Group (GCG), Accelrys, Inc., Madison, Wis.; and Backtranslation Applet from Entelechon GmbH, Regensburg, Germany. Thus, using the peptide sequences disclosed herein, one of ordinary skill in the art can design nucleic acids to yield optimal expression levels in the translation system or host cell of choice.

Expression and cloning vectors will likely contain a selectable marker, a gene encoding a protein necessary for survival or growth of a host cell transformed with the vector. The presence of this gene ensures growth of only those host cells that express the inserts. Typical selection genes encode proteins that 1) confer resistance to antibiotics or other toxic substances, e.g., ampicillin, neomycin, methotrexate, etc.; 2) complement auxotrophic deficiencies, or 3) supply critical nutrients not available from complex media, e.g., the gene encoding D-alanine racemase for *Bacilli*. Markers may be an inducible or non-inducible gene and will generally allow for positive selection. Non-limiting examples of markers include the ampicillin resistance marker (i.e., beta-lactamase), tetracycline resistance marker, neomycin/kanamycin resistance marker (i.e., neomycin phosphotransferase), dihydrofolate reductase, glutamine synthetase, and the like. The choice of the proper selectable marker will depend on the host cell, and appropriate markers for different hosts as understood by those of skill in the art.

Suitable expression vectors for use with the present invention include, but are not limited to, pUC, pBluescript (Stratagene), pET (Novagen, Inc., Madison, Wis.), and pREP (Invitrogen) plasmids. Vectors can contain one or more replication and inheritance systems for cloning or expression, one or more markers for selection in the host, e.g., antibiotic resistance, and one or more expression cassettes. The inserted coding sequences can be synthesized by standard methods, isolated from natural sources, or prepared as hybrids. Ligation of the coding sequences to transcriptional regulatory elements (e.g., promoters, enhancers, and/or insulators) and/or to other amino acid encoding sequences can be carried out using established methods.

Suitable cell-free expression systems for use with the present invention include, without limitation, rabbit reticulocyte lysate, wheat germ extract, canine pancreatic microsomal membranes, *E. coli* S30 extract, and coupled transcription/translation systems (Promega Corp., Madison, Wis.). These systems allow the expression of recombinant peptides upon the addition of cloning vectors, DNA fragments, or RNA sequences containing protein-coding regions and appropriate promoter elements.

Non-limiting examples of suitable host cells include bacteria, archea, insect, fungi (e.g., yeast), plant, and animal cells (e.g., mammalian, especially human). Of particular interest are Escherichia coli, *Bacillus subtilis, Saccharomyces cerevisiae*, SF9 cells, C129 cells, 293 cells, *Neurospora*, and immortalized mammalian myeloid and lymphoid cell lines. Techniques for the propagation of mammalian cells in culture are well-known (see, Jakoby and Pastan (Eds), 1979, Cell Culture. Methods in Enzymology, volume 58, Academic Press, Inc., Harcourt Brace Jovanovich, N.Y.). Examples of commonly used mammalian host cell lines are VERO and HeLa cells, CHO cells, and W138, BHK, and COS cell lines, although it will be appreciated by the skilled practitioner that other cell lines may be used, e.g., to provide higher expression, or other features.

Host cells can be transformed, transfected, or infected as appropriate by any suitable method including electroporation, calcium chloride-, lithium chloride-, lithium acetate/polyethylene glycol-, calcium phosphate-, DEAE-dextran-, liposome-mediated DNA uptake, spheroplasting, injection, microinjection, microprojectile bombardment, phage infection, viral infection, or other established methods. Alternatively, vectors containing the nucleic acids of interest can be transcribed in vitro, and the resulting RNA introduced into the host cell by well-known methods, e.g., by injection (see, Kubo et al., 1988, FEBS Lefts. 241:119). The cells into which have been introduced nucleic acids described above are meant to also include the progeny of such cells.

Nucleic acids encoding the peptides of the invention may be isolated directly from recombinant phage libraries (e.g., RAPIDLIB® or GRABLIB® libraries) described herein. Alternatively, the polymerase chain reaction (PCR) method can be used to produce nucleic acids of the invention, using the recombinant phage libraries as templates. Primers used for PCR can be synthesized using the sequence information provided herein and can further be designed to introduce appropriate new restriction sites, if desirable, to facilitate incorporation into a given vector for recombinant expression.

Nucleic acids encoding the peptides of the present invention can also be produced by chemical synthesis, e.g., by the phosphoramidite method described by Beaucage et al., 1981, Tetra. Letts. 22:1859–1862, or the triester method according to Matteucci et al., 1981, J. Am. Chem. Soc., 1103:3185, and can performed on commercial, automated oligonucleotide synthesizers. A double-stranded fragment may be obtained from the single-stranded product of chemical synthesis either by synthesizing the complementary strand and annealing the strands together under appropriate conditions or by adding the complementary strand using DNA polymerase with an appropriate primer sequence.

The nucleic acids encoding the peptides of the invention can be produced in large quantities by replication in a suitable host cell. Natural or synthetic nucleic acid fragments, comprising at least ten contiguous bases coding for a desired amino acid sequence can be incorporated into recombinant nucleic acid constructs, usually DNA constructs, capable of introduction into and replication in a prokaryotic or eukaryotic cell. Usually the nucleic acid constructs will be suitable for replication in a unicellular host, such as yeast or bacteria, but may also be intended for introduction to (with and without integration within the genome) cultured mammalian or plant or other eukaryotic cells, cell lines, tissues, or organisms. The purification of nucleic acids produced by the methods of the present invention is described, for example, in Sambrook et al., 1989;° F. M. Ausubel et al., 1992, Current Protocols in Molecular Biology, J. Wiley and Sons, New York, N.Y.

These nucleic acids can encode variant or truncated forms of the peptides as well as the reference peptides shown in FIGS. 1–4, 8, and 9 and Table 7, inter alia. Large quantities of the nucleic acids and peptides of the present invention may be prepared by expressing the nucleic acids or portions thereof in vectors or other expression vehicles in compatible prokaryotic or eukaryotic host cells. The most commonly used prokaryotic hosts are strains of *Escherichia coli*, although other prokaryotes, such as *Bacillus subtilis* or *Pseudomonas* may also be used. Mammalian or other eukaryotic host cells, such as those of yeast, filamentous fungi, plant, insect, or amphibian or avian species, may also be useful for production of the proteins of the present invention. For example, insect cell systems (i.e., lepidopteran host cells and baculovirus expression vectors) are particularly suited for large-scale protein production.

Host cells carrying an expression vector (i.e., transformants or clones) are selected using markers depending on the mode of the vector construction. The marker may be on the same or a different DNA molecule, preferably the same DNA molecule. In prokaryotic hosts, the transformant may be selected, e.g., by resistance to ampicillin, tetracycline or other antibiotics. Production of a particular product based on temperature sensitivity may also serve as an appropriate marker.

For some purposes, it is preferable to produce the peptide in a recombinant system in which the peptide contains an additional sequence (e.g., epitope or protein) tag that facilitates purification. Non-limiting examples of epitope tags include c-myc, haemagglutinin (HA), polyhistidine (6x-HIS)(SEQ ID NO: 1778), GLU—GLU, and DYKDDDDK (SEQ ID NO:1779) gr DYKD (SEQ ID NO:1545; FLAG®) epitope tags. Non-limiting examples of protein tags include glutathione-S-transferase (GST), green fluorescent protein (GFP), and maltose binding protein (MBP). In one approach, the coding sequence of a peptide can be cloned into a vector that creates a fusion with a sequence tag of interest. Suitable vectors include, without limitation, pRSET (Invitrogen Corp., San Diego, Calif.), pGEX (Amersham Pharmacia Biotech, Inc., Piscataway, N.J.), pEGFP (CLONTECH Laboratories, Inc., Palo Alto, Calif.), and PMA™ (New England BioLabs, Inc., Beverly, Mass.) plasmids. Following expression, the epitope or protein tagged peptide can be purified from a crude lysate of the translation system or host cell by chromatography on an appropriate solid-phase matrix. In some cases, it may be preferable to remove the epitope or protein tag (i.e., via protease cleavage) following purification.

Methods for directly purifying peptides from sources such as cellular or extracellular lysates are well known in the art (see Harris and Angal, 1989). Such methods include, without limitation, sodium dodecylsulfate-polyacrylamide gel electrophoresis (SDS-PAGE), preparative disc-gel electrophoresis, isoelectric focusing, high-performance liquid chromatography (HPLC), reversed-phase HPLC, gel filtration, ion exchange and partition chromatography, countercurrent distribution, and combinations thereof. Peptides can be purified from many possible sources, for example, plasma, body tissues, or body fluid lysates derived from human or animal, including mammalian, bird, fish, and insect sources.

Antibody-based methods may also be used to purify peptides. Antibodies that recognize these peptides or fragments derived therefrom can be produced and isolated. The peptide can then be purified from a crude lysate by chromatography on an antibody-conjugated solid-phase matrix (see Harlow and Lane, 1998).

2. Chemical Synthesis Of Peptides

Alternately, peptides may be chemically synthesized by commercially available automated procedures, including, without limitation, exclusive solid phase synthesis, partial solid phase methods, fragment condensation or classical solution synthesis. The peptides are preferably prepared by solid-phase peptide synthesis; for example, as described by Merrifield (1965; 1997).

According to methods known in the art, peptides can be chemically synthesized by commercially available automated procedures, including, without limitation, exclusive solid phase synthesis, partial solid phase methods, fragment condensation, classical solution synthesis. In addition, recombinant and synthetic methods of peptide production can be combined to produce semi-synthetic peptides. The peptides of the invention are preferably prepared by solid phase peptide synthesis as described by Merrifield, 1963, J. Am. Chem. Soc. 85:2149; 1997. In one embodiment, synthesis is carried out with amino acids that are protected at the alpha-amino terminus. Trifunctional amino acids with labile side-chains are also protected with suitable groups to prevent undesired chemical reactions from occurring during the assembly of the peptides. The alpha-amino protecting group is selectively removed to allow subsequent reaction to take place at the amino-terminus. The conditions for the removal of the alpha-amino protecting group do not remove the side-chain protecting groups.

The alpha-amino protecting groups are those known to be useful in the art of stepwise peptide synthesis. Included are acyl type protecting groups, e.g. formyl, trifluoroacetyl, acetyl, aromatic urethane type protecting groups, erg., benzyloxycarbonyl (Cbz), substituted benzyloxycarbonyl and 9-fluorenylmethyloxycarbonyl (Fmoc), aliphatic urethane protecting groups, e.g., t-butyloxycarbonyl (Boc), isopropyloxycarbonyl, cyclohexyloxycarbonyl, and alkyl type protecting groups, e.g., benzyl, triphenylmethyl. The preferred protecting group is Boc. The side-chain protecting groups for Tyr include tetrahydropyranyl, tert-butyl, trityl, benzyl, Cbz, 4-Br—Cbz and 2,6-dichlorobenzyl. The preferred side-chain protecting group for Tyr is 2,6-dichlorobenzyl. The side-chain protecting groups for Asp include benzyl, 2,6-dichlorobenzyl, methyl, ethyl, and cyclohexyl. The preferred side-chain protecting group for Asp is cyclohexyl. The side-chain protecting groups for Thr and Ser include acetyl, benzoyl, trityl, tetrahydropyranyl, benzyl, 2,6-dichlorobenzyl, and Cbz. The preferred protecting group for Thr and Ser is benzyl. The side-chain protecting groups for Arg include nitro, Tos, Cbz, adamantyloxycarbonyl, and Boc. The preferred protecting group for Arg is Tos. The side-chain amino group of Lys can be protected with Cbz, 2-Cl-Cbz, Tos, or Boc. The 2-Cl-Cbz group is the preferred protecting group for Lys.

The side-chain protecting groups selected must remain intact during coupling and not be removed during the deprotection of the amino-terminus protecting group or during coupling conditions. The side-chain protecting groups must also be removable upon the completion of synthesis, using reaction conditions that will not alter the finished peptide.

Solid phase synthesis is usually carried out from the carboxy-terminus by coupling the alpha-amino protected (side-chain protected) amino acid to a suitable solid support. An ester linkage is formed when the attachment is made to a chloromethyl or hydroxymethyl resin, and the resulting peptide will have a free carboxyl group at the C-terminus. Alternatively, when a benzhydrylamine or p-methylbenzhydrylamine resin is used, an amide bond is formed and the resulting peptide will have a carboxamide group at the C-terminus. These resins are commercially available, and their preparation has described by Stewart et al., 1984, Solid Phase Peptide Synthesis (2nd Edition), Pierce Chemical Co., Rockford, Ill.

The C-terminal amino acid, protected at the side chain if necessary and at the alpha-amino group, is coupled to the benzhydrylamine resin using various activating agents including dicyclohexylcarbodiimide (DCC), N,N'-diisopropyl-carbodiimide and carbonyldiimidazole. Following the attachment to the resin support, the alpha-amino protecting group is removed using trifluoroacetic acid (TFA) or HCl in dioxane at a temperature between 0 and 25° C. Dimethylsulfide is added to the TFA after the introduction of methionine (Met) to suppress possible S-alkylation. After removal of the alpha-amino protecting group, the remaining protected amino acids are coupled stepwise in the required order to obtain the desired sequence. Various activating agents can be used for the coupling reactions including DCC,N,N'diisopropyl-carbodiimide, benzotriazol-1-yl-oxy-tris-(dimethylamino) phosphonium hexa-fluorophosphate (BOP) and DCC-hydroxybenzotriazole (HOBt). Each protected amino acid is used in excess (>2.0 equivalents), and the couplings are usually carried out in N-methylpyrrolidone (NMP) or in DMF, $CH_2Cl_2$ or mixtures thereof. The extent of completion of the coupling reaction is monitored at each stage, e.g., by the ninhydrin reaction as described by Kaiser et al., 1970, Anal. Biochem. 34:595. In cases where incomplete coupling is found, the coupling reaction is repeated. The coupling reactions can be performed automatically with commercially available instruments.

After the entire assembly of the desired peptide, the peptide-resin is cleaved with a reagent such as liquid HF for 1–2 hours at 0° C., which cleaves the peptide from the resin and removes all side-chain protecting groups. A scavenger such as anisole is usually used with the liquid HF to prevent cations formed during the cleavage from alkylating the amino acid residues present in the peptide. The peptide-resin can be deprotected with TFA/dithioethane prior to cleavage if desired.

Side-chain to sidechain cyclization on the solid support requires the use of an orthogonal protection scheme which enables selective cleavage of the side-chain functions of acidic amino acids (e.g., Asp) and the basic amino acids (e.g., Lys). The 9-fluorenylmethyl (Fm) protecting group for the side-chain of Asp and the 9-fluorenylmethyloxycarbonyl (Fmoc) protecting group for the side-chain of Lys can be used for this purpose. In these cases, the side-chain protecting groups of the Boc-protected peptide-resin are selectively removed with piperidine in DMF. Cyclization is achieved on the solid support using various activating agents including DCC, DCC/HOBt, or BOP. The HF reaction is carried out on the cyclized peptide-resin as described above.

3. Peptide Libraries

Peptide libraries produced and screened according to the present invention are useful in providing new ligands for IR and IGF-R. Peptide libraries can be designed and panned according to methods described in detail herein, and methods generally available to those in the art (see, e.g., U.S. Pat. No. 5,723,286 issued Mar. 3, 1998 to Dower et al.). In one aspect, commercially available phage display libraries can be used (e.g., RAPIDLIB® or GRABLIBO, DGI BioTechnologies, Inc., Edison, N. J.; Ph.D. C7C Disulfide Constrained Peptide Library, New England Biolabs). In another aspect, an oligonucleotide library can be prepared according to methods known in the art, and inserted into an appropriate vector for peptide expression. For example, vectors encoding a bacteriophage structural protein, preferably an accessible phage protein, such as a bacteriophage coat protein, can be used. Although one skilled in the art will appreciate that a variety of bacteriophage may be employed in the present invention, in preferred embodiments the vector is, or is derived from, a filamentous bacteriophage, such as, for example, f1, fd, Pf1, M13, etc. In particular, the fd-tet vector has been extensively described in the literature (see, e.g., Zacher et al., 1980, Gene 9:127–140; Smith et al., 1985, Science 228:1315–1317; Parmley and Smith, 1988, Gene 73:305–318).

The phage vector is chosen to contain or is constructed to contain a cloning site located in the 5' region of the gene encoding the bacteriophage structural protein, so that the peptide is accessible to receptors in an affinity enrichment procedure as described hereinbelow. The structural phage protein is preferably a coat protein. An example of an appropriate coat protein is pIII. A suitable vector may allow oriented cloning of the oligonucleotide sequences that encode the peptide so that the peptide is expressed at or within a distance of about 100 amino acid residues of the N-terminus of the mature coat protein. The coat protein is typically expressed as a preprotein, having a leader sequence.

Thus, desirably the oligonucleotide library is inserted so that the N-terminus of the processed bacteriophage outer protein is the first residue of the peptide, i.e., between the 3'-terminus of the sequence encoding the leader protein and the 5'-terminus of the sequence encoding the mature protein or a portion of the 5' terminus. The library is constructed by cloning an oligonucleotide which contains the variable region of library members (and any spacers, as discussed below) into the selected cloning site. Using known recombinant DNA techniques (see generally, Sambrook et al., 1989, Molecular Cloning, A Laboratory Manual, 2d ed., Cold Spring Harbor Laboratory Press, Cold Spring Harbor, N.Y., 1989), an oligonucleotide may be constructed which, inter alia; 1) removes unwanted restriction sites and adds desired ones; 2) reconstructs the correct portions of any sequences which have been removed (such as a correct signal peptidase site, for example); 3) inserts the spacer residues, if any; and/or 4) corrects the translation frame (if necessary) to produce active, infective phage.

The central portion of the oligonucleotide will generally contain one or more IR and/or IGF-1R binding sequences and, optionally, spacer sequences. The sequences are ultimately expressed as peptides (with or without spacers) fused to or in the N-terminus of the mature coat protein on the outer, accessible surface of the assembled bacteriophage particles. The size of the library will vary according to the number of variable codons, and hence the size of the peptides, which are desired. Generally the library will be at least about $10_6$ members, usually at least $10^7$, and typically $10^8$ or more members. To generate the collection of oligonucleotides which forms a series of codons encoding a random collection of amino acids and which is ultimately cloned into the vector, a codon motif is used, such as (NNK), where N may be A, C, G, or T (nominally equimolar), K is G or T (nominally equimolar), and x is typically up to about 5, 6, 7, 8, or more, thereby producing libraries of penta-, hexa-, hepta-, and octa-peptides or larger. The third position may also be G or C, designated "S". Thus, NNK or NNS 1) code for all the amino acids; 2) code for only one stop codon; and 3) reduce the range of codon bias from 6:1 to 3:1.

It should be understood that, with longer peptides, the size of the library that is generated may become a constraint in the cloning process. The expression of peptides from randomly generated mixtures of oligonucleotides in appropriate recombinant vectors is known in the art (see, e.g., Oliphant et al., Gene 44:177–183). For example, the codon motif $(NNK)_6$ produces 32 codons, one for each of 12 amino acids, two for each of five amino acids, three for each of three amino acids and one (amber) stop codon. Although this motif produces a codon distribution as equitable as available with standard methods of oligonucleotide synthesis, it results in a bias against peptides containing one-codon residues. In particular, a complete collection of hexacodons contains one sequence encoding each peptide made up of only one-codon amino acids, but contains 729 ($3^6$) sequences encoding each peptide with only three-codon amino acids.

An alternative approach to minimize the bias against one-codon residues involves the synthesis of 20 activated trinucleotides, each representing the codon for one of the 20 genetically encoded amino acids. These are synthesized by conventional means, removed from the support while maintaining the base and 5-OH-protecting groups, and activated by the addition of 3'O-phosphoramidite (and phosphate protection with b-cyanoethyl groups) by the method used for the activation of mononucleosides (see, generally, McBride and Caruthers, 1983, Tetrahedron Letters 22:245). Degenerate oligocodons are prepared using these trimers as building blocks. The trimers are mixed at the desired molar ratios and installed in the synthesizer. The ratios will usually be approximately equimolar, but may be a controlled unequal ratio to obtain the over- to under-representation of certain amino acids coded for by the degenerate oligonucleotide collection. The condensation of the trimers to form the oligocodons is done essentially as described for conventional synthesis employing activated mononucleosides as building blocks (see, e.g., Atkinson and Smith, 1984, Oligonucleotide Synthesis, M. J. Gait, Ed., p.

35–82). This procedure generates a population of oligonucleotides for cloning that is capable of encoding an equal distribution (or a controlled unequal distribution) of the possible peptide sequences. Advantageously, this approach may be employed in generating longer peptide sequences, since the range of bias produced by the $(NNK)_6$ motif increases by three-fold with each additional amino acid residue.

When the codon motif is $(NNK)_x$, as defined above, and when x equals 8, there are $2.6 \times 10^{10}$ possible octa-peptides. A library containing most of the octa-peptides may be difficult to produce. Thus, a sampling of the octa-peptides may be accomplished by constructing a subset library using up to about 10% of the possible sequences, which subset of recombinant bacteriophage particles is then screened. If desired, to extend the diversity of a subset library, the recovered phage subset may be subjected to mutagenesis and then subjected to subsequent rounds of screening. This mutagenesis step may be accomplished in two general ways: the variable region of the recovered phage may be mutagenized, or additional variable amino acids may be added to the regions adjoining the initial variable sequences.

To diversify around active peptides (i.e., binders) found in early rounds of panning, the positive phage can sequenced to determine the identity of the active peptides. Oligonucleotides can then be synthesized based on these peptide sequences. The syntheses are done with a low level of all bases incorporated at each step to produce slight variations of the primary oligonucleotide sequences. This mixture of (slightly) degenerate oligonucleotides can then be cloned into the affinity phage by methods known to those in the art. This method produces systematic, controlled variations of the starting peptide sequences as part of a secondary library. It requires, however, that individual positive phage be sequenced before mutagenesis, and thus is useful for expanding the diversity of small numbers of recovered phage.

An alternate approach to diversify the selected phage allows the mutagenesis of a pool, or subset, of recovered phage. In accordance with this approach, phage recovered from panning are pooled and single stranded DNA is isolated. The DNA is mutagenized by treatment with, e.g., nitrous acid, formic acid, or hydrazine. These treatments produce a variety of damage to the DNA. The damaged DNA is then copied with reverse transcriptase, which misincorporates bases when it encounters a site of damage. The segment containing the sequence encoding the receptor-binding peptide is then isolated by cutting with restriction nuclease(s) specific for sites flanking the peptide coding sequence. This mutagenized segment is then recloned into undamaged vector DNA, the DNA is transformed into cells, and a secondary library according to known methods. General mutagenesis methods are known in the art (see Myers et al., 1985, Nucl. Acids Res. 13:3131–3145; Myers et al., 1985, Science 229:242–246; Myers, 1989, Current Protocols in Molecular Biology Vol. 1, 8.3.1–8.3.6, F. Ausubel et al., eds, J. Wiley and Sons, New York).

In another general approach, the addition of amino acids to a peptide or peptides found to be active, can be carried out using various methods. In one, the sequences of peptides selected in early panning are determined individually and new oligonucleotides, incorporating the determined sequence and an adjoining degenerate sequence, are synthesized. These are then cloned to produce a secondary library. Alternatively, methods can be used to add a second IR or IGF-1R binding sequence to a pool of peptide-bearing phage. In accordance with one method, a restriction site is installed next to the first IR or IGF-1R binding sequence. Preferably, the enzyme should cut outside of its recognition sequence. The recognition site may be placed several bases from the first binding sequence. To insert a second IR or IGF-1R binding sequence, the pool of phage DNA is digested and blunt-ended by filling in the overhang with Klenow fragment. Double-stranded, blunt-ended, degenerately synthesized oligonucleotides are then ligated into this site to produce a second binding sequence juxtaposed to the first binding sequence. This secondary library is then amplified and screened as before.

While in some instances it may be appropriate to synthesize longer peptides to bind certain receptors, in other cases it may be desirable to provide peptides having two or more IR or IGF-R binding sequences separated by spacer (e.g., linker) residues. For example, the binding sequences may be separated by spacers that allow the regions of the peptides to be presented to the receptor in different ways. The distance between binding regions may be as little as 1 residue, or at least 2–20 residues, or up to at least 100 residues. Preferred spacers are 3, 6, 9, 12, 15, or 18 residues in length. For probing large binding sites or tandem binding sites (e.g., Site 1 and Site 2 of IR), the binding regions may be separated by a spacer of residues of up to 20 to 30 amino acids. The number of spacer residues when present will typically be at least 2 residues, and often will be less than 20 residues.

The oligonucleotide library may have binding sequences which are separated by spacers (e.g., linkers), and thus may be represented by the formula: $(NNK)_y$–$(abc)_n$–$(NNK)_z$ where N and K are as defined previously (note that S as defined previously may be substituted for K), and y+z is equal to about 5, 6, 7, 8, or more, a, b and c represent the same or different nucleotides comprising a codon encoding spacer amino acids, n is up to about 3, 6, 9, or 12 amino acids, or more. The spacer residues may be somewhat flexible, comprising oligo-glycine, or oligoglycine-glycine-serine, for example, to provide the diversity domains of the library with the ability to interact with sites in a large binding site relatively unconstrained by attachment to the phage protein. Rigid spacers, such as, e.g., oligo-proline, may also be inserted separately or in combination with other spacers, including glycine spacers. It may be desired to have the IR or IGF-1R binding sequences close to one another and use a spacer to orient the binding sequences with respect to each other, such as by employing a turn between the two sequences, as might be provided by a spacer of the sequence glycine-proline-glycine, for example. To add stability to such a turn, it may be desirable or necessary to add cysteine residues at either or both ends of each variable region. The cysteine residues would then form disulfide bridges to hold the variable regions together in a loop, and in this fashion may also serve to mimic a cyclic peptide. Of course, those skilled in the art will appreciate that various other types of covalent linkages for cyclization may also be used.

Spacer residues as described above may also be situated on either or both ends of the IR or IGF-1R binding sequences. For instance, a cyclic peptide may be designed without an intervening spacer, by having a cysteine residue on both ends of the peptide. As described above, flexible spacers, e.g., oligo-glycine, may facilitate interaction of the peptide with the selected receptors. Alternatively, rigid spacers may allow the peptide to be presented as if on the end of a rigid arm, where the number of residues, e.g., proline residues, determines not only the length of the arm but also the direction for the arm in which the peptide is oriented. Hydrophilic spacers, made up of charged and/or uncharged hydrophilic amino acids, (e.g., Thr, His, Asn, Gin, Arg, Glu, Asp, Met, Lys, etc.), or hydrophobic spacers of hydrophobic amino acids (e.g., Phe, Leu, lie, Gly, Val, Ala, etc.) may be used to present the peptides to receptor binding sites with a variety of local environments.

Notably, some peptides, because of their size and/or sequence, may cause severe defects in the infectivity of their carrier phage. This causes a loss of phage from the population during reinfection and amplification following each cycle of panning. To minimize problems associated with defective infectivity, DNA prepared from the eluted phage can be transformed into appropriate host cells, such as, e.g., *E. coli*, preferably by electroporation—(see, e.g., Dower et al., Nucl. Acids Res. 16:6127–6145), or well known chemical means. The cells are cultivated for a period of time sufficient for marker expression, and selection is applied as typically done for DNA transformation. The colonies are amplified, and phage harvested for affinity enrichment in accordance with established methods. Phage identified in the affinity enrichment may be re-amplified by infection into the host cells. The successful transformants are selected by growth in an appropriate antibiotic(s), e.g., tetracycline or ampicillin. This may be done on solid or in liquid growth medium.

For growth on solid medium, the cells are grown at a high density (about $10^8$ to $10^9$ transformants per $m^2$) on a large surface of, for example, L-agar containing the selective antibiotic to form essentially a confluent lawn. The cells and extruded phage are scraped from the surface and phage are prepared for the first round of panning (see, e.g., Parmley and Smith, 1988, Gene 73:305–318). For growth in liquid culture, cells may be grown in L-broth and antibiotic through about 10 or more doublings. The phage are harvested by standard procedures (see Sambrook et al., 1989, Molecular Cloning, $2^{nd}$ ed.). Growth in liquid culture may be more convenient because of the size of the libraries, while growth on solid media likely provides less chance of bias during the amplification process.

For affinity enrichment of desired clones, generally about $10^3$ to $10^4$ library equivalents (a library equivalent is one of each recombinant; $10^4$ equivalents of a library of $10^9$ members is $10^9 \times 10^4 = 10^{13}$ phage), but typically at least 102 library equivalents, up to about 105 to 106, are incubated with a receptor (or portion thereof) to which the desired peptide is sought. The receptor is in one of several forms appropriate for affinity enrichment schemes. In one example the receptor is immobilized on a surface or particle, and the library of phage bearing peptides is then panned on the immobilized receptor generally according to procedures known in the art. In an alternate scheme, a receptor is attached to a recognizable ligand (which may be attached via a tether). A specific example of such a ligand is biotin. The receptor, so modified, is incubated with the library of phage and binding occurs with both reactants in solution. The resulting complexes are then bound to streptavidin (or avidin) through the biotin moiety. The streptavidin may be immobilized on a surface such as a plastic plate or on particles, in which case the complexes (phage/peptidelreceptor/biotin/streptavidin) are physically retained; or the streptavidin may be labeled, with a fluorophor, for example, to tag the active phage/peptide for detection and/or isolation by sorting procedures, e.g., on a fluorescence-activated cell sorter.

Phage that associate with IR or IGF-1R via non-specific interactions are removed by washing. The degree and stringency of washing required will be determined for each receptordpeptide of interest. A certain degree of control can be exerted over the binding characteristics of the peptides recovered by adjusting the conditions of the binding incubation and the subsequent washing. The temperature, pH, ionic strength, divalent cation concentration, and the volume and duration of the washing will select for peptides within particular ranges of affinity for the receptor. Selection based on slow dissociation rate, which is usually predictive of high affinity, is the most practical route. This may be done either by continued incubation in the presence of a saturating amount of free ligand, or by increasing the volume, number, and length of the washes. In each case, the rebinding of dissociated peptide-phage is prevented, and with increasing time, peptide-phage of higher and higher affinity are recovered. Additional modifications of the binding and washing procedures may be applied to find peptides that bind receptors under special conditions. Once a peptide sequence that imparts some affinity and specificity for the receptor molecule is known, the diversity around this binding motif may be embellished. For instance, variable peptide regions may be placed on one or both ends of the identified sequence. The known sequence may be identified from the literature, or may be derived from early rounds of panning in the context of the present invention.

G. Screening Assays

In another embodiment of this invention, screening assays to identify pharmacologically active ligands at IR and/or IGF-R are provided. Ligands may encompass numerous chemical classes, though typically they are organic molecules, preferably small organic compounds having a molecular weight of more than 50 and less than about 2,500 daltons. Such ligands can comprise functional groups necessary for structural interaction with proteins, particularly hydrogen bonding, and typically include at least an amine, carbonyl, hydroxyl or carboxyl group, preferably at least two of the functional chemical groups. Ligands often comprise cyclical carbon or heterocyclic structures and/or aromatic or polyaromatic structures substituted with one or more of the above functional groups. Ligands can also comprise biomolecules including peptides, saccharides, fatty acids, steroids, purines, pyrimidines, derivatives, structural analogs, or combinations thereof.

Ligands may include, for example, 1) peptides such as soluble peptides, including lg-tailed fusion peptides and members of random peptide libraries (see, e.g., Lam et al., 1991, Nature 354:82–84; Houghten et al., 1:991, Nature 354:84–86) and combinatorial chemistryderived molecular libraries made of D- and/or L-configuration amino acids; 2) phosphopeptides (e.g., members of random and partially degenerate, directed phosphopeptide libraries, see, e.g., Songyang et al., 1993, Cell 72:767–778);

3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules.

Ligands can be obtained from a wide variety of sources including libraries of synthetic or natural compounds. Synthetic compound libraries are commercially available from, for example, Maybridge Chemical Co. (Trevillet, Comwall, UK), Comgenex (Princeton, N.J.), Brandon Associates (Merrimack, N.H.), and Microsource (New Milford, Conn.). A rare chemical library is available from Aldrich Chemical Company, Inc. (Milwaukee, Wis.). Natural compound libraries comprising bacterial, fungal, plant or animal extracts are available from, for example, Pan Laboratories (Bothell, Wash.). In addition, numerous means are available for random and directed synthesis of a wide variety of organic compounds and biomolecules, including expression of randomized oligonucleotides.

Alternatively, libraries of natural compounds in the form of bacterial, fungal, plant and animal extracts can be readily produced. Methods for the synthesis of molecular libraries are readily available (see, e.g., DeWitt et al., 1993, Proc. Natl. Acad. Sci. USA 90:6909; Erb et al., 1994, Proc. Natl. Acad. Sci. USA 91:11422; Zuckermann et al., 1994, J. Med. Chem. 37:2678; Cho et al., 1993, Science 261:1303; Carell et al., 1994, Angew. Chem. Int. Ed. Engl. 33:2059; Carell et a!., 1994, Angew. Chem. Int. Ed. Engl. 33:2061; and in Gallop et al., 1994, J. Med. Chem. 37:1233). In addition, natural or synthetic compound libraries and compounds can be readily modified through conventional chemical, physical and biochemical means (see, e.g., Blondelle et al., 1996, Trends in Biotech. 14:60), and may be used to produce combinatorial libraries. In another approach, previously identified pharmacological agents can be subjected to directed or random chemical modifications, such as acylation, alkylation, esterification, amidification, and the analogs can be screened for IR-modulating activity.

Numerous methods for producing combinatorial libraries are known in the art, including those involving biological libraries; spatially addressable parallel solid phase or solution phase libraries; synthetic library methods requiring deconvolution; the 'one-bead one-compound' library method; and synthetic library methods using affinity chromatography selection. The biological library approach is limited to polypeptide or peptide libraries, while the other four approaches are applicable to polypeptide, peptide, non-peptide oligomer, or small molecule libraries of compounds (K. S. Lam, 1997, Anticancer Drug Des. 12:145).

Libraries may be screened in solution by methods generally known in the art for determining whether ligands competitively bind at a common binding site. Such methods may including screening libraries in solution (e.g., Houghten, 1992, Biotechniques 13:412421), or on beads (Lam, 1991, Nature 354:82–84), chips (Fodor, 1993, Nature 364:555556), bacteria or spores (Ladner U.S. Pat. No. 5,223,409), plasmids (Cull et at., 1992, Proc. Natl. Acad. Sci. USA 89:1865–1869), or on phage (Scott and Smith, 1990, Science 249:386–390; Deviun, 1990, Science 249:404406; Cwiria et al, 0.1:990, Proc. Natl. Acad. Sci. USA 97:6378–6382; Felici, 1991, J. Mol. Biol. 222:301–310; Ladner, supra).

Where the screening assay is a binding assay, IR, or one of the IR-binding peptides disclosed herein, may be joined to a label, where the label can directly or indirectly provide a detectable signal. Various labels include radioisotopes, fluorescent molecules, chemiluminescent molecules, enzymes, specific binding molecules, particles, e.g., magnetic particles, and the like. Specific binding molecules include pairs, such as biotin and streptavidin, digoxin and antidigoxin, etc. For the specific binding members, the complementary member would normally be labeled with a molecule that provides for detection, in accordance with known procedures.

A variety of other reagents may be included in the screening assay. These include reagents like salts, neutral proteins, e.g., albumin, detergents, etc., which are used to facilitate optimal protein—protein binding and/or reduce non-specific or background interactions. Reagents that improve the efficiency of the assay, such as protease inhibitors, nuclease inhibitors, anti-microbial agents, etc., may be used. The components are added in any order that produces the requisite binding. Incubations are performed at any temperature that facilitates optimal activity, typically between 4° and 40°0 C. Incubation periods are selected for optimum activity, but may also be optimized to facilitate rapid high-throughput screening. Normally, between 0.1 and 1 hr will be sufficient. In general, a plurality of assay mixtures is run in parallel with different test agent concentrations to obtain a differential response to these concentrations. Typically, one of these concentrations serves as a negative control, i.e., at zero concentration or below the level of detection.

The screening assays provided in accordance with this invention are based on those disclosed in International application WO 96/04557, which is incorporated herein in its entirety. Briefly, WO 96/04557 discloses the use of reporter peptides that bind to active sites on targets and possess agonist or antagonist activity at the target. These reporters are identified from recombinant libraries and are either peptides with random amino acid sequences or variable antibody regions with at least one CDR region that has been randomized (rVab). The reporter peptides may be expressed in cell recombinant expression systems, such as for example in *E. coli*, or by phage display (see WO 96/04557 and Kay et al. 1996, Mol. Divers. 1!(2):13940, both of which are incorporated herein by reference). The reporters identified from the libraries may then be used in accordance with this invention either as therapeutics themselves, or in competition binding assays to screen for other molecules, preferably small, active molecules, which possess similar properties to the reporters and may be developed as drug candidates to provide agonist or antagonist activity. Preferably, these small organic molecules are orally active.

The basic format of an in vitro competitive receptor binding assay as the basis of a heterogeneous screen for small organic molecular replacements for insulin may be as follows: occupation of the active site of IR is quantified by time-resolved fluorometric detection (TRFD) with streptavidin-labeled europium (saEu) complexed to biotinylated peptides (bP). In this assay, saEu forms a ternary complex with bP and IR (i.e., IR:bP:saEu complex). The TRFD assay format is well established, sensitive, and quantitative (Tompkins et al., 1993, J. Immunol. Methods 163:209–216). The assay can use a single-chain antibody or a biotinylated peptide. Furthermore, both assay formats faithfully report the competition of the biotinylated ligands binding to the active site of IR by insulin.

In these assays, soluble IR is coated on the surface of microtiter wells, blocked by a solution of 0.5% bovine serum albumin (BSA) and 2% non-fat milk in PBS, and then incubated with biotinylated peptide or rVab. Unbound bP is then washed away and saEu is added to complex with receptor-bound bP. Upon addition of the acidic enhancement solution, the bound europium is released as free $Eu^{3+}$ which rapidly forms a highly fluorescent and stable complex with components of the enhancement solution. The IR:bP bound saEu is then converted into its highly fluorescent state and detected by a detector such as Wallac Victor II (EG&G Wallac, Inc.)

Phage display libraries can also be screened for ligands that bind to IR or IGF-1R, as described above. Details of the construction and analyses of these libraries, as well as the basic procedures for biopanning and selection of binders, have been published (see, e.g., WO 96104557; Mandecki et al., 1997, Display Technologies—Novel Targets and Strategies, P. Guttry (ed), International Business Communications, Inc. Southborogh, Mass., pp. 231–254; Ravera et al., 1998, Oncogene 16:1993–1999; Scott and Smith, 1990, Science 249:386–390); Grihalde et al., 1995, Gene 166:187–195; Chen et al., 1996, Proc. Natl. Acad. Sci. USA 93:1997–2001; Kay et al., 1993, Gene 128:59–65; Carcamo et al., 1998, Proc. Natl. Acad. Sci. USA 95:11146–11151; Hoogenboom, 1997, Trends Biotechnol. 15:62–70; Rader and Barbas, 1997, Curr. Opin. Biotechnol. 8:503–508; all of which are incorporated herein by reference).

The designing of mimetics to a known pharmaceutically active compound is a known approach to the development of pharmaceuticals based on a "lead" compound. This might be desirable where the active compound is difficult or expensive to synthesize or where it is unsuitable for a particular method of administration, e.g., peptides are generally unsuitable active agents for oral compositions as they tend to be quickly degraded by proteases in the alimentary canal. Mimetic design, synthesis, and testing are generally used to avoid large-scale screening of molecules for a target property.

There are several steps commonly taken in the design of a mimetic from a compound having a given target property. First, the particular parts of the compound that are critical and/or important in determining the target property are determined. In the case of a peptide, this can be done by systematically varying the amino acid residues in the peptide (e.g., by substituting each residue in turn). These parts or residues constituting the active region of the compound are known as its "pharmacophore".

Once the pharmacophore has been found, its structure is modeled according to its physical properties (e.g., stereochemistry, bonding, size, and/or charge), using data from a range of sources (e.g., spectroscopic techniques, X-ray diffraction data, and NMR). Computational analysis, similarity mapping (which models the charge and/or volume of a pharmacophore, rather than the bonding between atoms), and other techniques can be used in this modeling process.

In a variant of this approach, the three dimensional structure of the ligand and its binding partner are modeled. This can be especially useful where the ligand and/or binding partner change conformation on binding, allowing the model to take account of this in the design of the mimetic.

A template molecule is then selected, and chemical groups that mimic the pharmacophore can be grafted onto the template. The template molecule and the chemical groups grafted on to it can conveniently be selected so that the mimetic is easy to synthesize, is likely to be pharmacologically acceptable, does not degrade in vivo, and retains the biological activity of the lead compound. The mimetics found are then screened to ascertain the extent they exhibit the target property, or to what extent they inhibit it. Further optimization or modification can then be carried out to arrive at one or more final mimetics for in vivo or clinical testing.

This invention provides specific IR and IGF-1R amino acid sequences that function as either agonists or antagonists at IR and/or IGF-1R. Additional sequences may be obtained in accordance with the procedures described herein.

H. Use of the Peptides Provided by This Invention

The IR and IGF-1R agonist and antagonist peptides provided by this invention are useful as lead compounds for identifying other more potent or selective therapeutics, assay reagents for identifying other useful ligands by, for example, competition screening assays, as research tools for further analysis of IR and IGF-1R, and as potential therapeutics in pharmaceutical compositions. In one embodiment, one or more of the disclosed peptides can be provided as components in a kit for identifying other ligands (e.g., small, organic molecules) that bind to IR or IGF-1R. Such kits may also comprise IR or IGF-1R, or functional fragments thereof. The peptide and receptor components of the kit may be labeled (e.g., by radioisotopes, fluorescent molecules, chemiluminescent molecules, enzymes or other labels), or may be unlabeled and labeling reagents may be provided. The kits may also contain peripheral reagents such as buffers, stabilizers, etc. Instructions for use can also be provided.

In another embodiment, the peptide sequences provided by this invention can be used to design secondary peptide libraries, which are derived from the peptide sequences, and include members that bind to Site 1 and/or Site 2 of IR or IGF-1R. Such libraries can be used to identify sequence variants that increase or modulate the binding and/or activity of the original peptide at IR or IGF-1R, as described in the related applications of Beasley et al. International Application PCT/U.S. 00/08528, filed Mar. 29, 2000, and Beasley et al., U.S. application Ser. No. 09/538,038, filed Mar. 29, 2000, in accordance with well-established techniques.

IR agonist amino acid sequences provided by this invention are useful as insulin analogs and may therefore be developed as treatments for diabetes or other diseases associated with a decreased response or production of insulin. For use as an insulin supplement or replacement, amino acid sequences include D117/H$_2$C: FHENFYDWFVRQVSK (SEQ ID NO:1780); D117/H$_2$C minusterminal lysine: FHENFYDWFVRQVS (SEQ ID NO:1557); D118: DYKD-FYDAIQLVRSARAGGTRDKK (SEQ ID NO:1781); D118 minus FLAG® tag and terminal lysines: FYDAIQLVRSA-RAGGTRD (SEQ ID NO:1782); D119: KDRAFYNGL-RDLVGAVYGAWDKK (SEQ ID NO:1733); D19 minus terminal lysines: KDRAFYNGLRDLVGAVYGAWD (residues 1–21 of SEQ ID NO: 1733); D116/JBA5: DYKDLCQSWGVRIGWLAGLCPKK (SEQ ID NO:1541); D116/JBA5 minus FLAG® tag and terminal lysines: LCQSWGVRIGWLAGLCP (SEQ ID NO:1542); D113/H2: DYKDVTFTSAVFHENFYDWFVRQVSKK (SEQ ID NO:1783); D113/H2 minus FLAG®) tag and terminal lysines: VTFTSAVFHENFYDWFVRQVS (SEQ ID NO:1784); and S175: GRVDWLQRNANFYDWF-VAELG (SEQ ID NO: 1560). Preferred peptide dimer sequences are represented by S325, S332, S333, S335, S337, S353, S374–S376, S378, S379, S381, S414, S415, and S418 (see Table 7). Other preferred dimers sequences are represented by S455, S457, S458, S467, S468, S471, S499, S510, S518, S519, and S520 sequences (see Table 7). Especially preferred is the S519 dimer sequence, which shows in vitro and in vivo activity comparable to insulin (see FIGS. 31A–C, 32A–B, and 33).

IGF-1R antagonist amino acid sequences provided by this invention are useful as treatments for cancers, including, but not limited to, breast, prostate, colorectal, and ovarian cancers. Human and breast cancers are responsible for over 40,000 deaths per year, as present treatments such as surgery, chemotherapy, radiation therapy, and immunotherapy show limited success. The IGF-1R antagonist amino acid sequences disclosed herein are also useful for the treatment or prevention of diabetic retinopathy. Recent reports have shown that a previously identified IGF-1R antagonist can suppress retinal neovascularization, which causes diabetic retinopathy (Smith et al., 1999, Nat. Med. 5:1390–1395).

IGF-1R agonist amino acid sequences provided by this invention are useful for development as treatments for neurological disorders, including stroke and diabetic neuropathy. Reports of several different groups implicate IGF-1R in the reduction of global brain ischemia, and support the use of IGF-1 for the treatment of diabetic neuropathy (reviewed in Auer et al., 1998, Neurology 51:S39–S43; Apfel, 1999, Am. J. Med. 107:34S42S).

I. Methods of Administration The amino acid sequences of this invention may be administered as pharmaceutical compositions comprising standard carriers known in the art for delivering proteins and peptides and by gene therapy. Preferably, a pharmaceutical composition includes, in admixture, a pharmaceutically (i.e., physiologically) acceptable carrier, excipient, or diluent, and one or more of an IR or IGF-1R agonist or antagonist peptide, as an active ingredient. The preparation of pharmaceutical compositions that contain peptides as active ingredients is well understood in the art. Typically, such compositions are prepared as injectables, either as liquid solutions or suspensions, however, solid forms suitable for solution in, or suspension in, liquid prior to injection can also be prepared. The preparation can also be emulsified. The active therapeutic ingredient is often mixed with excipients that are pharmaceutically (i.e., physiologically) acceptable and compatible with the active ingredient. Suitable excipients are, for example, water, saline, dextrose, glycerol, ethanol, or the like and combinations thereof. In addition, if desired, the composition can contain minor amounts of auxiliary substances such as wetting or emulsifying agents, pH-buffering agents, which enhance the effectiveness of the active ingredient.

An IR or IGF-1R agonist or antagonist peptide can be formulated into a pharmaceutical composition as neutralized physiologically acceptable salt forms. Suitable salts include the acid addition salts (i.e., formed with the free amino groups of the peptide molecule) and which are formed with inorganic acids such as, for example, hydrochloric or phosphoric acids, or such organic acids as acetic, oxalic, tartaric, mandelic, and the like. Salts formed from the free carboxyl groups can also be derived from inorganic bases such as, for example, sodium, potassium, ammonium, calcium, or ferric hydroxides, and such organic bases as isopropylamine, trimethylamine, 2-ethylamino ethanol, histidine, procaine, and the like.

The pharmaceutical compositions can be administered systemically by oral or parenteral routes. Non-limiting parenteral routes of administration include subcutaneous, intramuscular, intraperitoneal, intravenous, transferal, inhalation, intranasal, intra-arterial, intrathecal, enteral, sublingual, or rectal. Due to the labile nature of the amino acid sequences parenteral administration is preferred. Preferred modes of administration include aerosols for nasal or bronchial absorption; suspensions for intravenous, intramuscular, intrasternal or subcutaneous, injection; and compounds for oral administration.

Intravenous administration, for example, can be performed by injection of a unit dose. The term "unit dose" when used in reference to a pharmaceutical composition of the present invention refers to physically discrete units suitable as unitary dosage for humans, each unit containing a predetermined quantity of active material calculated to produce the desired therapeutic effect in association with the required diluent; i.e., liquid used to dilute a concentrated or pure substance (either liquid or solid), making that substance the correct (diluted) concentration for use. For injectable administration, the composition is in sterile solution or suspension or may be emulsified in pharmaceutically- and physiologically-acceptable aqueous or oleaginous vehicles, which may contain preservatives, stabilizers, and material for rendering the solution or suspension isotonic with body fluids (i.e., blood) of the recipient.

Excipients suitable for use are water, phosphate buffered saline, pH 7.4, 0.15 M aqueous sodium chloride solution, dextrose, glycerol, dilute ethanol, and the like, and mixtures thereof. Illustrative stabilizers are polyethylene glycol, proteins, saccharides, amino acids, inorganic acids, and organic acids, which may be used either on their own or as admixtures. The amounts or quantities, as well as routes of administration, used are determined on an individual basis, and correspond to the amounts used in similar types of applications or indications known to those of skill in the art.

Pharmaceutical compositions are administered in a manner compatible with the dosage formulation, and in a therapeutically effective amount. The quantity to be administered depends on the subject to be treated, capacity of the subject's immune system to utilize the active ingredient, and degree of modulation of IR or IGF-LR activity desired. Precise amounts of active ingredient required to be administered depend on the judgment of the practitioner and are specific for each individual. However, suitable dosages may range from about 10 to 200 nmol active peptide per kilogram body weight of individual per day and depend on the route of administration. Suitable regimes for initial administration and booster shots are also variable, but are typified by an initial administration followed by repeated doses at one or more hour intervals by a subsequent injection or other administration. Alternatively, continuous intravenous infusions sufficient to maintain picomolar concentrations (e.g., approximately 1 μM to approximately 10 nM) in the blood are contemplated. An exemplary formulation comprises the IR or IGF-1R agonist or antagonist peptide in a mixture with sodium busulfite USP (3.2 mg/ml); disodium edetate USP (0.1 mg/ml); and water for injection q.s.a.d. (1 ml).

Further guidance in preparing pharmaceutical formulations can be found in, e.g., Gilman et al. (eds), 1990, Goodman and Gilman's: The Pharmacological Basis of Therapeutics, 8th ed., Pergamon Press; and Remington's Pharmaceutical Sciences, 17th ed., 1990, Mack Publishing Co., Easton, Pa.; Avis et al. (eds), 1993, Pharmaceutical Dosage Forms: Parenteral Medications, Dekker, N.Y.; Lieberman et al. (eds), 1990, Pharmaceutical Dosage Forms: Disperse Systems, Dekker, N. Y.

The present invention further contemplates compositions comprising an IR or IGF-1R agonist or antagonist peptide, and a physiologically acceptable carrier, excipient, or diluent as described in detail herein.

The constructs as described herein may also be used in gene transfer and gene therapy methods to allow the expression of one or more amino acid sequences of the present invention. The amino acid sequences of the present invention can be used for gene therapy and thereby provide an alternative method of treating diabetes which does not rely on the administration or expression of insulin. Expressing insulin for use in gene therapy requires the expression of a precursor product, which must then undergo processing including cleavage and disulfide bond formation to form the active product. The amino acid sequences of this invention, which possess activity, are relatively small, and thus do not require the complex processing steps to become active. Accordingly, these sequences provide a more suitable product for gene therapy.

Gene transfer systems known in the art may be useful in the practice of the gene therapy methods of the present invention. These include viral and non-viral transfer methods. A number of viruses have been used as gene transfer vectors, including polyoma, i.e., SV40 (Madzak et al., 1992, J. Gen. Virol., 73:1533–1536), adenovirus (Berkner, 1992, Cuff. Top. Microbiol. Immunol., 158:39–6; Berkner et al., 1988, Bio Techniques, 6:61629; Gorziglia et al., 1992, J. Virol., 66:44074412; Quantin et al., 1992, Proc. Natl. Acad. Sci. USA, 89:2581–2584; Rosenfeld et al., 1992, Cell, 68:143–155; Wilkinson et al., 1992, Nucl. Acids Res., 20:2233–2239; Strafford-Perricaudet et al., 1990, Hum. Gene Ther., 1:241–256), vaccinia virus (Mackeft et al., 1992, Biotechnology, 24:495–499), adeno-associated virus (Muzyczka, 1992, Curr. Top. Microbiol. Immunol. 158:91–123; Ohi et al., 1990, Gene, 89:279–282), herpes viruses including HSV and EBV (Margolskee, 1992, Curr. Top. Microbiol. Immunol. 158:67–90; Johnson et al., 1992, J. Virol., 66:2952–2965; Fink et al., 1992, Hum. Gene Ther. 3:11–19; Breakfield et al., 1987, Mol. NeurobioL, 1:337–371; Fresse et al., 1990, Biochem. Pharmacol. 40:2189–2199), and retroviruses of avian (Brandyopadhyay et al., 1984, Mol. Cell Biol., 4:749–754; Petropouplos et al., 1992, J. Virol., 66:3391–3397), murine (Miller, 1992, Curr. Top. Microbiol. Immunol. 158:1–24; Miller et al., 1985, Mol. Cell Biol., 5:431437; Sorge et al., 1984, Mol. Cell Biol., 4:1730–1737; Mann et al., 1985, J. Vimol., 54:401–407), and human origin (Page et al., 1990, J. Virol., 64:5370–5276; Buchschalcher et a!., 1992, J. Viro!., 66:2731–2739). Most human gene therapy protocols have been based on disabled murine retroviruses.

Non-viral gene transfer methods known in the art include chemical techniques such as calcium phosphate coprecipitation (Graham et al., 1973, Virology, 52:456467; Pellicer et a!., 1980, Science, 209:1414–1422), mechanical techniques, for example microinjection (Anderson et al., 1980, Pros. Natl. Acad. Sci. USA, 77:5399–5403; Gordon et al., 1980, Proc. Natl. Acad. Sci. USA, 77:7380–7384; Brinster et al., 1981, Cell, 27:223–231; Constantini et al., 1981, Nature, 294:92–94), membrane fusion-mediated transfer via liposomes (Felgner et a!., 1987, Proc. Natl. Acad. Sci. USA, 84:7413–7417; Wang et al., 1989, Biochemistry, 28:9508–9514; Kaneda et al., 1989, J. Biol. Chem., 264:12126–12129; Stewart et al., 1992, Hum. Gene Ther. 3:267–275; Nabel et al., 1990, Science, 249:1285–1288; Lim et a!., 1992, Circulation, 83:2007–2011; U.S. Pat. Nos. 5,283,185 and 5,795,587), and direct DNA uptake and receptor-mediated DNA transfer (Wolff et al., 1990, Science, 247:1465–1468; Wu et al., 1991, BioTechniques, 11:474485; Zenke et al., 1990, Proc. Natl. Acad. Sci. USA, 87:3655–3659; Wu et a!., 1989, J. Biol. Chem., 264:16985–16987; Wolff et al., 1991, BioTechniques, 11:474485; Wagner et al., 1991, Proc. Natl. Acad. Sci. USA, 88:42554259; Cotten et al., 1990, Proc. Natl. Acad. Sci. USA, 87:40334037; Curiel et al., 1991, Proc. Natl. Acad. Sci. USA, 88:8850–8854; Curiel et al., 1991, Hum. Gene Ther. 3:147–154).

Many types of cells and cell lines (e.g., primary cell lines or established cell lines) and tissues are capable of being stably transfected by or receiving the constructs of the invention. Examples of cells that may be used include, but are not limited to, stem cells, B lymphocytes, T lymphocytes, macrophages, other white blood lymphocytes (e.g., myelocytes, macrophages, or monocytes), immune system cells of different developmental stages, erythroid lineage cells, pancreatic cells, lung cells, muscle cells, liver cells, fat cells, neuronal cells, glial cells, other brain cells, transformed cells of various cell lineages corresponding to normal cell counterparts (e.g., K562, HEL, HL60, and MEL cells), and established or otherwise transformed cells lines derived from all of the foregoing. In addition, the constructs of the present invention may be transferred by various means directly into tissues, where they would stably integrate into the cells comprising the tissues. Further, the constructs containing the DNA sequences of the peptides of the invention can be introduced into primary cells at various stages of development, including the embryonic and fetal stages, so as to effect gene therapy at early stages of development.

In one approach, plasmid DNA is complexed with a polylysine-conjugated antibody specific to the adenovirus hexon protein, and the resulting complex is bound to an adenovirus vector. The trimolecular complex is then used to infect cells. The adenovirus vector permits efficient binding, internalization, and degradation of the endosome before the coupled DNA is damaged.

In another approach, liposome/DNA is used to mediate direct in vivo gene transfer. While in standard liposome preparations the gene transfer process is non-specific, localized in vivo uptake and expression have been reported in tumor deposits, for example, following direct in situ administration (Nabel, 1992, Hum. Gene Ther. 3:399410).

Suitable gene transfer vectors possess a promoter sequence, preferably a promoter that is cell-specific and placed upstream of the sequence to be expressed. The vectors may also contain, optionally, one or more expressible marker genes for expression as an indication of successful transfection and expression of the nucleic acid sequences contained in the vector. In addition, vectors can be optimized to minimize undesired immunogenicity and maximize long-term expression of the desired gene product(s) (see Nabe, 1999, Proc. Natl. Acad. Sci. USA 96:324–326). Moreover, vectors can be chosen based on cell-type that is targeted for treatment.

Illustrative examples of vehicles or vector constructs for transfection or infection of the host cells include replication-defective viral vectors, DNA virus or RNA virus (retrovimus) vectors, such as adenovirus, herpes simplex virus and adeno-associated viral vectors. Adeno-associated virus vectors are single stranded and allow the efficient delivery of multiple copies of nucleic acid to the cell's nucleus. Preferred are adenovirus vectors. The vectors will normally be substantially free of any prokaryotic DNA and may comprise a number of different functional nucleic acid sequences. An example of such functional sequences may be a DNA region comprising transcriptional and translational initiation and termination regulatory sequences, including promoters (e.g., strong promoters, inducible promoters, and the like) and enhancers which are active in the host cells. Also included as part of the functional sequences is an open reading frame (polynucleotide sequence) encoding a protein of interest. Flanking sequences may also be included for site-directed integration. In some situations, the 5'-flanking sequence will allow homologous recombination, thus changing the nature of the transcriptional initiation region, so as to provide for inducible or non-inducible transcription to increase or decrease the level of transcription, as an example.

In general, the encoded and expressed peptide may be intracellular, i.e., retained in the cytoplasm, nucleus, or in an organelle, or may be secreted by the cell. For secretion, a signal sequence may be fused to the peptide sequence. As previously mentioned, a marker may be present for selection of cells containing the vector construct. The marker may be an inducible or non-inducible gene and will generally allow for positive selection under induction, or without induction, respectively. Examples of marker genes include neomycin, dihydrofolate reductase, glutamine synthetase, and the like. The vector employed will generally also include an origin of replication and other genes that are necessary for replication in the host cells, as routinely employed by those having skill in the art. As an example, the replication system comprising the origin of replication and any proteins associated with replication encoded by a particular virus may be included as part of the construct. The replication system must be selected so that the genes encoding products necessary for replication do not ultimately transform the cells. Such replication systems are represented by replication-defective adenovirus (see G. Acsadi et al., 1994, Hum. Mol. Genet. 3:579–584) and by Epstein-Barr virus. Examples of replication defective vectors, particularly, retroviral vectors that are replication defective, are BAG, (see Price et al., 1987, Proc. Natl. Acad. Sci. USA, 84:156; Sanes et at., 1986, EMBO J., 5:3133). It will be understood that the final gene construct may contain one or more genes of interest, for example, a gene encoding a bioactive metabolic molecule. In addition, cDNA, synthetically produced DNA or chromosomal DNA may be employed utilizing methods and protocols known and practiced by those having skill in the art.

According to one approach for gene therapy, a vector encoding an IR or IGF-R agonist or antagonist peptide is directly injected into the recipient cells (in vivo gene therapy). Alternatively, cells from the intended recipients are explanted, genetically modified to encode an IR or IGF-1R agonist or antagonist peptide, and reimplanted into the donor (ex vivo gene therapy). An ex vivo approach provides the advantage of efficient viral gene transfer, which is superior to in vivo gene transfer approaches. In accordance with ex vivo gene therapy, the host cells are first transfected with engineered vectors containing at least one gene encoding an IR or IGF-R agonist or antagonist peptide, suspended in a physiologically acceptable carrier or excipient such as saline or phosphate buffered saline, and the like, and then administered to the host or host cells. The desired gene product is expressed by the injected cells, which thus introduce the gene product into the host. The introduced gene products can thereby be utilized to treat or ameliorate a disorder that is related to altered insulin or IGF-1 levels (e.g., diabetes).

The described constructs may be administered in the form of a pharmaceutical preparation or composition containing a pharmaceutically acceptable carrier and a physiological excipient, in which preparation the vector may be a viral vector construct, or the like, to target the cells, tissues, or organs of the recipient organism of interest, including human and non-human mammals. The composition may be formed by dispersing the components in a suitable pharmaceutically acceptable liquid or solution such as sterile physiological saline or other injectable aqueous liquids. The amounts of the components to be used in such compositions may be routinely determined by those having skill in the art. The compositions may be administered by parenteral routes of injection, including subcutaneous, intravenous, intramuscular, and intrasternal.

EXAMPLES

The examples as set forth herein are meant to exemplify the various aspects of the present invention and are not intended to limit the invention in any way.

The following materials were used in the examples described below. Soluble IGF-1R was obtained from R&D Systems (Minneapolis, Minn.; Cat. # 391-GRICF). Insulin receptor was prepared according to Bass et al., 1996. The insulin was either from Sigma (St. Louis, Mo.; Cat. # 1-0259) or Boehringer. The IGF-1 was from PeproTech (Cat. # 100-11). All synthetic peptides were synthesized by Novo Nordisk, AnaSpec, Inc. (San Jose, Calif.), PeptioGenics (Livermore, Calif.), or Research Genetics (Huntsville, Ala.) at >80% purity. The Maxisorb Plates were from NUNC via Fisher (Cat. # 12565347). The HRP/Anfi-M13 conjugate was from Pharmacia (Cat. # 27-9421-01). The ABTS solution was from BioF/X (Cat. # ABTS-0100-04).

Example 1

Monomer and Dimer Peptides

A. Cloning

Monomer and dimer peptides were constructed and expressed as protein fusions to a chitin binding domain (CBD) using the pTYB2 vector from the IMPAC™-CN system (New England Biolabs (NEB), Beverly, Mass.). The pTYB2 vector encodes a protein-splicing element (termed intein), which initiates self-cleavage upon the addition of DTT. The intein selfleavage separates the dimer from the affinity tag, to allow purification.

In the pTYB2 construct, the C-terminus of the peptide sequence was fused to the N-terminus of the intein/CBD sequence. Two peptide-flanking epitope tags were included: a shortened-FLAG® at the N-terminus and E-Tag at the C-terminus. This fusion was generated by ligating a vector fragment encoding the intein/CBD with a PCR product encoding the peptide of interest.

The vector fragment was obtained by digesting at appropriate restriction sites the pTBY2 vector. The digested DNA fragment was resolved on a 1% agarose gel, excised, and purified by QIAEXI (QIAGEN, Valencia, Calif.). To obtain the PCR product of the target proteins, primers were synthesized which anneal to appropriate sequences. The vector and insert were ligated overnight at 15° C. The ligation product was purified using QIAquick spin columns (QIAGEN) and electroporations were performed at 1500 V in an electroporation cuvette (0.1 mm gap; 0.5 ml volume) containing 10 ng of DNA and 40 µl of E. coli strain BL21.

Immediately following electroporation, 1 ml of prewarmed (40° C.) 2xYT medium containing 2% glucose (2xYT-G) was added to the transformants. The transformants were grown at 37° C. for 1 h, and then plated onto 2xYT-AG plates and incubated overnight at 37° C. Individual colonies were isolated and used to innoculate 2xYT-G. The cultures were grown overnight at 37° C. Plasmid DNA was isolated from the cultures and sequencing was performed to confirm that the correct construct was obtained.

B. Small-Scale Expression of Peptide-Cbd Fusion Proteins

E.coli ER2566 (New England Biolabs) containing plasmids encoding peptide-CBD fusion proteins were grown in 2xYT-AG at 3rC overnight, with agitation (250 rpm). The following day, the cultures were used to inoculate media (2xYT-G) to obtain an $OD_{600}$ of 0.1. Upon reaching an ODWO of 0.6, expression of the fusion protein was induced by the addition of IPTG (isopropyl-p-D-thiogalactopyranoside) to a final concentration of 0.3 mM. Cells were grown for 3 h. Following this, cells were pelleted by centrifugation and the cell pellets were analyzed by SDS-PAGE electrophoresis. Production of the correct molecular weight fusion proteins was confirmed by Western blot analysis using the monoclonal antibody anti-E-Tag-HRP conjugate (Amersham Pharmacia).

C. Large-Scale Expression and Purification of Soluble peptide-CBD fusion proteins E. coli ER2566 carrying plasmids encoding the fusion proteins were grown in 2xYT-AG media at 37rC for 8 h, with agitation (250 rpm). The cultures were back-diluted into to 2 L volumes of 2xYT-A to achieve an $OD_{600}$ of 0.1. Upon reaching an $OD_{600}$ of 0.5, IPTG was added to a final concentration of 0.3 mM. Cells were grown at 30° C. overnight. The next day cells were isolated by centrifugation. Samples of the cell pellet were analyzed by SDS-PAGE followed by the Western blot analysis using the mouse monoclonal antibody anti-E-Tag-HRP conjugate (Pharmacia) to visualize the expressed product.

D. Purification

The cell pellets were disrupted mechanically by sonication or chemically by treatment with the mild detergent. After removal of cell debris by centrifugation, the soluble proteins in the clarified lysate were prepared for chromatographic purification by dilution or dialysis into the appropriate starting buffer. The CBD fusions were purified by chitin affinity chromatography according to the manufacturer's instructions (New England Biolabs). The lysate was loaded onto a chibn affinity column and the column was washed with 10 volumes of column buffer. Three bed volumes of the DTT containing cleavage buffer were loaded onto the column and the column was incubated overnight. The next day, the target protein was eluted by continuing the flow of the cleavage buffer without DTT. The purified proteins were analyzed for purity and integrity by SDS-PAGE and Western blot analysis according to standard protocols.

Example 2

PEG-Based Dimer Peptides

A. Synthesis of the Aldehyde Containing Peptide

The peptide was synthesized by stepwise solid phase synthesis on Rink amide Tentagel (0.21 mmol/g). Three equivalents of Fmoc-amino acids were used. The serine residue was introduced into the peptide by either coupling Fmoc-Ser(tBu)-OH to the N-terminal peptide or coupling Boc-Ser(tBu) to a selectively protected lysine sidechain. The peptide was then deprotected and cleaved from the resin by treatment with 95% TFA (trifluoroacetic acid; aq) containing TIS (triisopropylsilan). Periodate oxidation, using 2 equivalent of $NalO_4$ in 20% DMSO (dimethyl sulfoxide)-80% phosphate buffer pH 7.5 (45 iIJumol peptide) for 5 min at room temperature (RT), converted the 2-amino alcohol moiety in an α-oxoacyl group. The peptide was purified immediately following oxidation.

B. Synthesis of the PEG-based dimer

The unprotected and oxidized peptide (4.2 equivalent) was dimerized on the dioxyamino-PEG (polyethylene glycol)-linker (1 equivalent) in 90% DMSO-10% 20 mM NaOAc buffer, pH 5.1 (4.2 µl/µmol peptide). The solution was left for 1 hr at 38° C. and the progress of the reaction was monitored by MALDI-MS (matrix-assisted laser desorption/ionization mass spectrometry). Following this, the crude dimer was purified by semi-LC preparative HPLC (high performance liquid chromatography).

The molecular weights and inter peptide distance of various linkers is shown in Table 3, below.

TABLE 3
| Structure | Number | MW | MW (−2H₂O) |
|---|---|---|---|
| 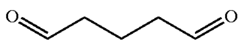 | 1 | 100.1 | 64.1 |
| 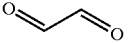 | 2 | 58.04 | 22.04 |
| 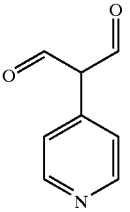 | 3 | 149.15 | 113.15 |
| 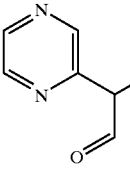 | 4 | 150.14 | 114.14 |
| 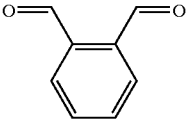 | 5 | 134.13 | 98.13 |
| 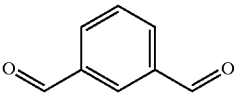 | 6 | 134.13 | 98.13 |
| 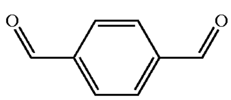 | 7 | 134.13 | 98.13 |
| 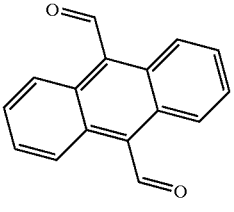 | 8 | 234.25 | 198.25 |
| 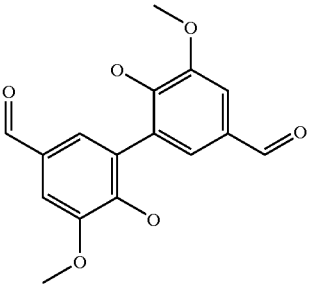 | 9 | 302.3 | 266.3 |
| 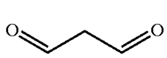 | 10 | 72.06 | 36.06 |
| 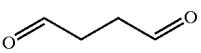 | 11 | 86.09 | 50.09 |

TABLE 3-continued

| Structure | Number | MW | MW (−2H$_2$O) |
|---|---|---|---|
| 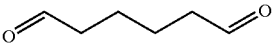 | 12 | 114.14 | 78.14 |
| 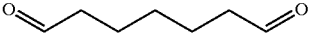 | 13 | 128.08 | 92.08 |
| 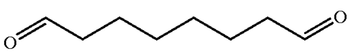 | 14 | 142.19 | 106.19 |
| (HCO)$_4$-(Lys)$_2$-Lys-Gly-NH$_2$ | 15 | | |
| 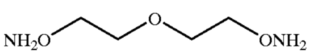 | 16 | 136.2 | 100.2 |
| 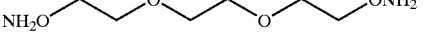 | 17 | 180.2 | 144.2 |
| 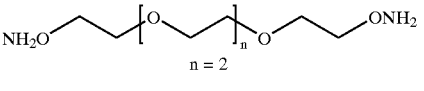 n = 2 | 18 | 224.3 | 188.3 |
| 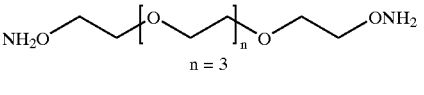 n = 3 | 19 | 268.3 | 232.3 |
| 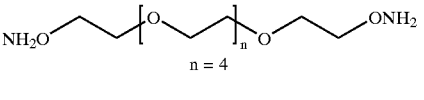 n = 4 | 20 | 312.4 | 276.4 |
| 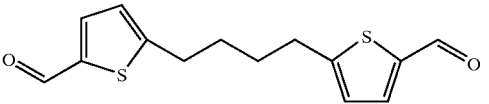 | 21 | 278.4 | 242.4 |
| 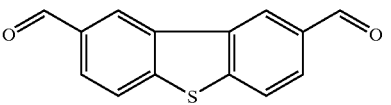 | 22 | 240.3 | 204.3 |
| 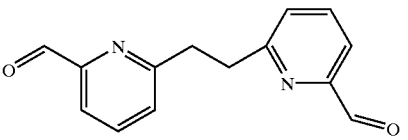 | 23 | 240.3 | 204.3 |
| 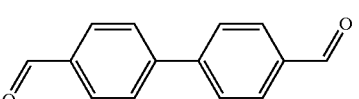 | 24 | 210.2 | 192.2 |

Example 3

Determination of Insulin Receptor Binding

IR was incubated with $^{125}$I-labeled insulin at various concentrations of test substance and the K$_d$ was calculated. According to this method, human insulin receptor (HIR) or human IGF-1 receptor (HIGF-1R) was purified from transfected cells after solubilization with Triton X-100. The assay buffer contained 100 mM HEPES (pH 7.8), 100 mM NaCl, 10 mM MgCl$_2$, 0.5% human serum albumin (HSA), 0.2% gammaglobulin and 0.025% Triton X-100. The receptor concentration was chosen to give 3060% binding of 2000 cpm (3 μM) of its $^{125}$I-labeled ligand (TyrA14-$^{125}$1-HI or Tyr31-$^{125}$I-HI or Tyr31-$^{125}$|-|-IGF1) and a dilution series of the substance to be tested was added. After equilibration for 2 days at 4° C., each sample (200 μl) was precipitated by addition of 400 μl 25% PEG 6000, centrifuged, washed with 1 ml 15% PEG 6000, and counted in a gamma-counter.

The insulin/IGF-1 competition curve was fitted to a one-site binding model and the calculated parameters for receptor concentration, insulin affinity, and non-specific binding were used in calculating the binding constants of the test substances. Representative curves for insulin competition are shown in FIGS. 10A–10C; 11A–11D. Qualitative data are provided in Table 4, below.

Table 4 illustrates IR affinities for the RP9 monomer peptide and various RP9 monomer truncations. The results demonstrate that RP9 N-terminal sequence (GSLD; SEQ ID NO:1785) and C-terminal sequence (LGKK; SEQ ID NO:1786) can be deleted without substantially affecting HIR binding affinity (Table 4).

TABLE 4

| Peptide | SEQ ID NO: | Formula | Site IR | Sequence | HIR Kd (mol/l) |
|---|---|---|---|---|---|
| S386 | 1559 | 1 | 1 | GSLDESFYDWFERQLG | $3.2 * 10^{-7}$ |
| S395 | 1787 | 1 | 1 | GSLDESFYDWFERQL | $9.1 * 10^{-8}$ |
| S394 | 1788 | 1 | 1 | GSLDESFYDWFERQ | $8.1 * 10^{-8}$ |
| S396 | 1789 | 1 | 1 | GSLDESFYDWFER | $>2 * 10^{-5}$ |
| S399 | 1790 | 1 | 1 | ESFYDWFERQL | $9.1 * 10^{-8}$ |
| S400 | 1791 | 1 | 1 | ESFYDWFERQ | $6.3 * 10^{-7}$ |

FIGS. 10A–10C demonstrate that Site 1-Site 2 heterodimer peptides 537, 538, and 539 bound to IR with substantially higher (several orders of magnitude) affinity than corresponding monomer (D117 and 540) and homodimer (521 and 535) peptides. FIGS. 11A–11D demonstrate that Site 1-Site 2 heterodimer peptides, 537 and 538, bound to IR with markedly higher affinity than the monomer peptide D117.

Example 4

Adipocyte Assay for Determination of Insulin Agonist Activity

Insulin increases uptake of $^3$H glucose into adipocytes and its conversion into lipid. Incorporation of $^3$H into the lipid phase was determined by partitioning of lipid phase into a scintillant mixture, which excludes water-soluble $^3$H products. The effect of compounds on the incorporation of $^3$H glucose at a sub-maximal insulin dose was determined, and the results expressed as increase relative to full insulin response. The method was adapted from Moody et al., 1974, Horm Metab Res. 6(1):12–6.

Mouse epididymal fat pads were dissected out, minced into digestion buffer (Krebs-Ringer 25 mM HEPES, 4% HSA, 1.1 mM glucose, 0.4 mg/ml Collagenase Type 1, pH 7.4), and digested for up to 1.5 h at 36.5° C. After filtration, washing (Krebs-Ringer HEPES, 1% HSA), and resuspension in assay buffer (Krebs-Ringer HEPES, 1% HSA), free fat cells were pipetted into 96-well Picoplates (Packard), containing test solution and approximately an $E0_{20}$ insulin.

The assay was started by addition of $^3$H glucose (Amersham TRK 239), in a final concentration of 0.45 mM glucose. The assay was incubated for 2 h, 36.5° C., in a Labshaker incubation tower, 400 rpm, then terminated by the addition of Permablend/Toluene scintillant (or equivalent), and the plates sealed, before standing for at least 1 h and detection in a Packard Top Counter or equivalent. A full insulin standard curve (8 dose) was run as control on each plate.

Data are presented graphically, as effect of compound on an (approximate) $ED_{20}$ insulin response, with data normalized to a full insulin response. The assay can also be run at basal or maximal insulin concentration. Representative dose-response curves for insulin and IGF-1 are shown in FIGS. 12–18. Qualitative data are shown in Tables 57.

In free fat cell (FFC) assays, truncated synthetic RP9 monomer peptides S390 and S394 showed potency similar to full-length RP9 monomer peptides (FIGS. 12A–12D). Truncated synthetic RP9 homodimer peptides S415 and S417 were highly potent in FFC assays, but less potent than full-length RP9 homodimer peptides (FIGS. 13A–13C; compare to peptides 521 and 535, described below). The potency of recombinant RP9 homodimer peptides 521 and 535 in FFC assays is shown in FIGS. 14A–14C. The curves are flattened, suggesting that the binding mechanism may not be mediated by simple intramolecular binding (FIGS. 14A–14C).

Results further indicated that synthetic RP9 homodimer peptides S337 and S374 showed increased HIR biding affinity and increased potency in FFC assays compared to synthetic RP9 monomer, S371 (Table 5). Similarly, synthetic RP9 homodimer peptides S314 and S317 showed increased HIR binding affinity and increased potency in FFC assays compared to synthetic RP9 monomer, S371, and various RP9 truncations (Table 6).

TABLE 5

| Pep. | SEQ ID NO: | Formula | Site IR | Monomer or Dimer | Sequence | HIR $K_d$ (mol/l) | FFC |
|---|---|---|---|---|---|---|---|
| S371 | 1558 | 1 | 1 | M (RP9) | GSLDESFYDWFERQLGKK | $6.3 * 10^{-7}$ | + |
| S337 | 1792 | 1-1 | 1-1 | D, C-Term 23 | (GSLDESFYDWFERQLGKK-Lig)$_2$-23 | $1.1 * 10^{-8}$ | +++++ |
| S374 | 1793 | 1-1 | 1-1 | D, N-Term 17 | 17-(GSLDESFYDWFERQLGKK)$_2$ | $1.8 * 10^{-7}$ | ++++ |

M = monomer; D = dimer; C-Term = C-terminal linker (C-C); N-Term = N-terminal linker (N-N); 23 and 17 represent specific chemical linkers (see Table 3);
For FFC: 0 is no effect, + is agonist, - is antagonist.

TABLE 6

| Peptide | SEQ ID NO: | Form. | Site IR | Mon. or Dimer | Sequence | HIR $K_d$ (mol/l) | FFC |
|---|---|---|---|---|---|---|---|
| S371 (RP9) | 1558 | 1 | 1 | M | GSLDESFYDWFERQLGKK | $6.3 * 10^{-7}$ | + |
| S395 | 1787 | 1 | 1 | M | GSLDESFYDWFERQL | $9.1 * 10^{-8}$ | + |
| S394 | 1788 | 1 | 1 | M | GSLDESFYDWFERQ | $8.1 * 10^{-8}$ | ++ |
| S396 | 1789 | 1 | 1 | M | GSLDESFYDWFER | $>2 * 10^{-5}$ | 0 |
| S390 | 1794 | 1 | 1 | M | ESFYDWFERQLG | $6.2 * 10^{-7}$ | + |
| S399 | 1790 | 1 | 1 | M | ESFYDWFERQL | $9.1 * 10^{-8}$ | ++ |
| S400 | 1791 | 1 | 1 | M | ESFYDWFERQ | $6.3 * 10^{-7}$ | 0 |

TABLE 6-continued

| Peptide | SEQ ID NO: | Form. | Site IR Mon. or Dimer | Sequence | HIR $K_d$ (mol/l) | FFC |
|---|---|---|---|---|---|---|
| S415 | 1795 | 1-1 | 1-1 D; C-Term | (ESFYDWFERQLGK)$_2$-23 | $1.0 * 10^{-7}$ | ++++ |
| S417 | 1796 | 1-1 | 1-1 D; N-Term | 23-(ESFYDWFERQLG)$_2$ | $9.2 * 10^{-7}$ | +++ |

M = monomer; D = dimer; C-Term = C-terminal linker (C-C); N-Term = N-terminal linker (N-N); 23 represents a specific chemical linker (see Table 3);
For FFC: 0 is no effect, + is agonist, - is antagonist; Form. = formula;
Mon. = monomer;

Site 1-Site 2 dimer peptides 537 and 538 were inactive in the FFC assays using the standard concentration of insulin (FIGS. 15A–15C). However, Site 1-Site 2 dimer peptides 537 and 538 were antagonists in the FFC assay in the presence of a stimulating concentration of insulin (FIGS. 16A–16C). In contrast, Site 2-Site 1 dimer peptide 539 was a full agonist in the FFC assay, with a slope similar to that of insulin (FIGS. 17A–17B).

Additional experiments confirmed that FFC assay activity of Site 1-Site 2 dimer peptides was affected by the orientation of the monomer subunits (FIGS. 18A–18D). In particular, dimer peptides comprising Site 1 (S372 or S373) and Site 2 (S451 or S452) monomer subunits exhibited antagonist activity in the Site 1-Site 2 orientation (C—N linkage) (dimer peptide S453); moderate levels of agonist activity in the Site 1-Site 2 orientation (N—N or C—C linkage) (dimer peptides S454 and S456); and high levels of agonist activity in the Site 2-Site 1 orientation (C—N linkage) (dimer peptide S455) (FIGS. 18A–18D).

Table 7, below, shows the HIR binding affinity and FFC assay potency of various synthetic peptides, including Site 1-Site 1 dimer peptides S325, S329, S332; S333, S334, S335, S336, S337, S349, S350, S351, S352, S353, S354, S361, S362, S363, S374, S375, S376, S378, S379, S380, S381, S414, S415, S416, S417, S418, S420, and S424. These synthetic dimer peptides exhibited properties comparable to dimer peptides 521 and 535, regardless of the orientation of the monomer subunits. In particular, synthetic Site 1-Site 2 dimer peptides S425, S453, and S459 exhibited antagonist properties comparable to those of the Site 1-Site 2 dimer peptides 537 and 538. Synthetic Site 1-Site 2 dimer peptides S455, S457, and S458 exhibited agonist properties comparable to the dimer peptide 539. Synthetic Site 1-Site 2 dimer peptides S436, S437, S438, S454, S456 act as partial agonists in the FFC assay (i.e., the peptides exhibit a maximal response of less than 100% that of insulin), which is shown in the table as "++" and "+++".

Table 7 also shows properties of truncated monomer and dimer peptides, and thereby indicates which N- or C-terminal residues can be deleted without substantial loss of HIR binding affinity (e.g., see synthetic peptides S386 through S392, S394 through S403, and S436 through S445). Notably, certain Site 2-Site 1 dimers show IR affinities of $2*10^{-11}$ (see, e.g., S519 and S520). These peptides are also very potent in the fat cell assay (FIGS. 31A–31B) and even more potent in the HIR kinase assay (FIGS. 32A–32B) (kinase assay described below).

TABLE 7

| Peptide | SEQ ID NO: | Formula | Linkage | Site | IR | Sequence | HIR Kd (mol/l) | FFC |
|---|---|---|---|---|---|---|---|---|
| S105 | 1797 | F1 | — | | 1 | FHENFYDWFVRQVAKK | $3.1 * 10^{-7}$ | ++ |
| S106 | 1798 | F1 | — | | 1 | FHENFYDWFVRQASKK | $4.2 * 10^{-7}$ | ++ |
| S107 | 1799 | F1 | — | | 1 | FHENFYDWFVRAVSKK | $10.0 * 10^{-7}$ | + |
| S108 | 1800 | F1 | — | | 1 | FHENFYDWFVAQVSKK | $7.5 * 10^{-7}$ | ++ |
| S109 | 1801 | F1 | — | | 1 | FHENFYDWFARQVSKK | $2.3 * 10^{-7}$ | ++ |
| S110 | 1802 | F1 | — | | 1 | FHEAFYDWFVRQVSKK | $2.2 * 10^{-7}$ | + |
| S111 | 1803 | F1 | — | | 1 | FHANFYDWFVRQVSKK | $3.3 * 10^{-7}$ | 0 |
| S112 | 1804 | F1 | — | | 1 | FAENFYDWFVRQVSKK | $6.1 * 10^{-7}$ | + |
| S113 | 1805 | F1 | — | | 1 | AHENFYDWFVRQVSKK | $5.9 * 10^{-7}$ | + |
| S114 | 1556 | F1 | — | | 1 | fhenfydwfvrqvskk | $8.3 * 10^{-6}$ | 0 |
| S115 | 1806 | F1 | — | | | EFHENFYDWFVRQVSEE | $6.5 * 10^{-6}$ | + |
| S116 | 1807 | F1 | — | | | FHENFYGWFVRQVSKK | $1.4 * 10^{-6}$ | ++ |
| S117 | 1808 | F2 | — | | 1 | HETFYSMIRSLAK | $2.7 * 10^{-6}$ | 0 |
| S118 | 1809 | F2 | — | | 1 | SDGFYNAIELLS | $2.4 * 10^{-6}$ | + |
| S119 | 1810 | F2 | — | | 1 | SLNFYDALQLLAKK | $1.8 * 10^{-6}$ | 0 |
| S120 | 1811 | F2 | — | | 1 | HDPFYSMMKSLLK | $2.0 * 10^{-6}$ | 0 |
| S121 | 1812 | F2 | — | | 1 | NSFYEALRMLSSK | $3.1 * 10^{-6}$ | 0 |
| S122 | 1813 | F7 | — | | 1 | HPTSKEIYAKLLK | $9.3 * 10^{-6}$ | 0 |
| S123 | 1814 | F7 | — | | 1 | HPSTNQMLMKLFK | $1.6 * 10^{-5}$ | 0 |
| S124 | 1815 | F7 | — | | | HPPLSELKLFLIKK | $2.3 * 10^{-5}$ | 0 |
| S127 | 1816 | F2 | — | | 1 | WSDFYSYFQGLD | $1.2 * 10^{-6}$ | 0 |
| S128 | 1817 and 1818 | F1-F1 | C-C | 1-1 | | (FHENFYDWFVRQVSKK)$_2$-Dap | $1.1 * 10^{-6}$ | ++ |
| S129 | 1819 | F2 | — | | 1 | SSNFYQALMLLS | $2.9 * 10^{-6}$ | 0 |
| S131 | 1820 | F1 | — | | 1 | FHENFYDWFVRQVSKK-Lig | $1.2 * 10^{-6}$ | + |
| S137 | 1821 | F1 | — | | 1 | HENFYGWFVRQVSKK | $7.7 * 10^{-7}$ | 0 |
| S145 | 1822 and 1823 | F1-F1 | C-C | 1-1 | | (FHENFYDWFVRQVSKK)$_2$-Lys | $1.5 * 10^{-6}$ | ++ |
| S158 | 1780 | F1 | — | | 1 | FHENFYDWFVRQVSK | $8.1 * 10^{-7}$ | + |
| S165 | 1554 | F1 | — | | 1 | FYDWF | $>2 * 10^{-5}$ | 0 |
| S166 | 1824 | F1 | — | | 1 | FYDWFKK | $>2 * 10^{-5}$ | 0 |
| S167 | 1825 | F1 | — | | 1 | AFYDWFAKK | $3.8 * 10^{-6}$ | 0 |
| S168 | 1826 | F1 | — | | 1 | AAAAFYDWFAAAAKK | $5.8 * 10^{-7}$ | ++ |
| S169 | 1827 and 1828 | F1-F1 | N-N | 1-1 | | 12-(Lig-FHENFYDWFVRQVSKK)$_2$ | $7.0 * 10^{-7}$ | +++ |
| S170 | 1829 and 1830 | F1-F1 | N-N | 1-1 | | (CGFHENFYDWFVRQVSKK)$_2$(linked at cysteines) | $2.9 * 10^{-6}$ | +++ |
| S171 | 1831 | F1 | — | | 1 | CGFHENFYDWFVRQVSKK | $4.8 * 10^{-6}$ | ++ |
| S172 | 1832 and 1833 | F1-F1 | N-N | 1-1 | | 14-(Lig-FHENFYDWFVRQVSKK)$_2$ | $1.2 * 10^{-6}$ | 0 |
| S173 | 1834 | F3 | — | | 1 | LDALDRLMRYFEERPSL | $1.6 * 10^{-5}$ | +++ |
| S174 | 1835 | F3 | — | | 1 | PLAELWAYFEHSEQGRSSAH | $2.3 * 10^{-7}$ | 0 |
| S175 | 1560 | F1 | — | | 1 | GRVDWLQRNANFYDWFVAELG | $4.7 * 10^{-7}$ | +++ |
| S176 | 1836 | F2 | — | | 1 | NGVERAGTGDNFYDWFVAQLH | $2.7 * 10^{-6}$ | + |
| S177 | 1837 | F2 | — | | 1 | EHWNTVDPFYPTLFEWLRESG | $1.3 * 10^{-7}$ | ++ |
| S178 | 1838 | F2 | — | | 1 | EHWNTVDPFYQYFSELLRESG | $5.4 * 10^{-7}$ | + |
| S179 | 1839 | F1 | — | | 1 | QSDSGTVHDRFYGWFRDTWAS | $>2 * 10^{-5}$ | 0 |
| S180 | 1840 | F1 | — | | 1 | AFYDWFAK | $>2 * 10^{-5}$ | — |
| S181 | 1841 | F1 | — | | 1 | AFYDWFA | $>2 * 10^{-5}$ | 0 |
| S182 | 1842 | F1 | — | | 1 | AFYDWF | $>2 * 10^{-5}$ | 0 |
| S183 | 1843 | F1 | — | | 1 | FYDWFA | $>2 * 10^{-5}$ | 0 |
| S184 | 1844 | F1 | — | | 1 | Ac-FYDWF | $>2 * 10^{-5}$ | 0 |
| S214 | 1845 | F1 | — | | 1 | AFYEWFAKK | $>2 * 10^{-5}$ | 0 |
| S215 | 1846 | F1 | — | | 1 | AFYGWFAKK | $>2 * 10^{-5}$ | 0 |

TABLE 7-continued

| Peptide | SEQ ID NO: | Formula | Linkage | Site IR | Sequence | HIR Kd (mol/1) | FFC |
|---|---|---|---|---|---|---|---|
| S216 | 1847 | F1 | — | 1 | AFYKWFAKK | $>2 * 10^{-5}$ | 0 |
| S217 | 1848 and 1849 | F2-F2 | C-C | 1-1 | (SDGFYNAIELLS-Lig)$_2$-14 | $3.9 * 10^{-8}$ | ++ |
| S218 | 1850 and 1851 | F1-F1 | C-C | 1-1 | (AFYDWFAKK-Lig)$_2$-14 | $1.1 * 10^{-5}$ | 0 |
| S219 | 1852 | F1 | — | 1 | FHENAYDWFVRQVSKK | $>2 * 10^{-5}$ | 0 |
| S220 | 1853 | F1 | — | 1 | FHENFADWFVRQVSKK | $>2 * 10^{-5}$ | 0 |
| S221 | 1854 | F1 | — | 1 | FHENFYAWFVRQVSKK | $1.1 * 10^{-6}$ | + |
| S222 | 1855 | F1 | — | 1 | FHENFYDAFVRQVSKK | $>2 * 10^{-5}$ | 0 |
| S223 | 1856 | F1 | — | 1 | FHENFYDWAVRQVSKK | $>2 * 10^{-5}$ | 0 |
| S226 | 1857 | F6 | — | 2 | QLEEEWAGVQCEVYGRECPS | $1.6 * 10^{-6}$ | 0 |
| S227 | 1858 | F1 | — | 1 | CGGFHENFYDWFVRQVSKK | $5.1 * 10^{-7}$ | ++ |
| S228 | 1859 and 1860 | F1-F1 | N-N | 1-1 | (CGGFHENFYDWFVRQVSKK)$_2$(linked at cysteines) | $3.6 * 10^{-7}$ | ++ |
| S229 | 1861 and 1862 | F2-F4 | C-C | 1-2 | SDGFYNAIELLS-Lig 12 | $4.4 * 10^{-9}$ | 0 |
| | | | | | KHLCVLEELFWGASLFGYCSGKK-Lig | | |
| S231 | 1863 and 1864 | F1-F1 | C-C | 1-1 | (FHENFYDWFVRQVSKKGGG-Lig)$_2$-14 | $2.7 * 10^{-7}$ | + |
| S232 | 1865 and 1866 | F1-F1 | N-N | 1-1 | 14-(Lig-GGGFHENFYDWFVRQVSKK)$_2$ | $3.8 * 10^{-7}$ | +++ |
| S233 | 1867 and 1868 | F1-F2 | C-C | 1-1 | FHENFYDWFVRQVSKK-Lig 14 | $2.6 * 10^{-7}$ | + |
| | | | | | SDGFYNAIELLS-Lig | | |
| S234 | 1869 | F1 | — | 1 | RVDWLQRNANFYDWFVAELG | $1.3 * 10^{-7}$ | ++ |
| S235 | 1870 | F1 | — | 1 | VDWLQRNANFYDWFVAELG | $5.3 * 10^{-8}$ | ++ |
| S236 | 1871 | F1 | — | 1 | DWLQRNANFYDWFVAELG | $1.0 * 10^{-7}$ | ++ |
| S237 | 1872 | F1 | — | 1 | WLQRNANFYDWFVAELG | $8.5 * 10^{-7}$ | 0 |
| S238 | 1873 | F1 | — | 1 | LQRNANFYDWFVAELG | $8.5 * 10^{-6}$ | 0 |
| S239 | 1874 | F1 | — | 1 | QRNANFYDWFVAELG | $1.3 * 10^{-6}$ | 0 |
| S240 | 1875 | F1 | — | 1 | RNANFYDWFVAELG | $1.4 * 10^{-6}$ | |
| S241 | 1876 | F1 | — | 1 | NANFYDWFVAELG | $1.6 * 10^{-6}$ | |
| S242 | 1877 | F1 | — | 1 | ANFYDWFVAELG | $2.0 * 10^{-6}$ | |
| S243 | 1878 | F1 | — | 1 | NFYDWFVAELG | $2.0 * 10^{-6}$ | |
| S244 | 1879 | F1 | — | 1 | GRVDWLQRNANFYDWFVAELG-Lig | $2.2 * 10^{-7}$ | ++ |
| S245 | 1880 | F1 | — | 1 | Lig-GRVDWLQRNANFYDWFVAELG | $2.2 * 10^{-7}$ | + |
| S246 | 1881 and 1882 | F8-F1 | C-C | 3-1 | ACAWPTYWNCGGGG-Lig 14 | $5.0 * 10^{-6}$ | |
| | | | | | FHENFYDWFVRQVSKK-Lig | | |
| S248 | 1883 | F1 | — | 1 | GRVDWLQRNANFYDWFVAEL | $6.3 * 10^{-8}$ | ++ |
| S249 | 1884 | F1 | — | 1 | GRVDWLQRNANFYDWFVAE | $7.4 * 10^{-7}$ | 0 |
| S250 | 1885 | F1 | — | 1 | GRVDWLQRNANFYDWFVA | $8.9 * 10^{-6}$ | 0 |
| S251 | 1886 | F1 | — | 1 | GRVDWLQRNANFYDWFV | $5.6 * 10^{-6}$ | 0 |
| S252 | 1887 and 1888 | F2-F2 | C-C | 1-1 | (SDGFYNAIELLS-Lig)$_2$-14 | $4.4 * 10^{-7}$ | ++ |
| S253 | 1889 and 1890 | F1-F1 | C-C | 1-1 | (GRVDWLQRNANFYDWFVAELG-Lig)$_2$-14 | $2.2 * 10^{-8}$ | ++ |
| S255 | 1891 and 1892 | F2-F2 | C-C | 1-1 | (SDGFYNAIELLSGGG-Lig)$_2$-14 | $1.6 * 10^{-7}$ | 0 |
| S256 | 1893 | F6 | — | 2 | Acy-CLEEwGASL-Tic-QCSG | $9.0 * 10^{-6}$ | 0 |
| S257 | 1894 | F2 | — | 1 | RWPNFYGYFESLLTHFS | $1.4 * 10^{-5}$ | 0 |
| S259 | 1895 | F2 | — | 1 | EGWDFYSYFSGLLASVT | $7.7 * 10^{-6}$ | 0 |
| S260 | 1896 | F2 | — | 1 | LDRQFYRYFQDLLVGFM | $2.3 * 10^{-6}$ | 0 |
| S261 | 1897 | F2 | — | 1 | WGRSFYRYFETLLAQGI | $>2 * 10^{-5}$ | 0 |
| S262 | 1898 | F4 | — | 1 | PLCFLQELFGGASLGGYCSG | $1.9 * 10^{-5}$ | 0 |
| S263 | 1899 | F6 | — | 2 | WLEQERAWIWCEIQGSGCRA | $>2 * 10^{-5}$ | 0 |
| S264 | 1900 | F1 | — | 1 | IQGWEPFYGWFDDVVAQMFEE | $1.9 * 10^{-7}$ | 0 |
| S265 | 1901 | F1 | — | 1 | TGHRLGLDEQFYWFRDALSG | $1.1 * 10^{-7}$ | 0 |

TABLE 7-continued

| Peptide | SEQ ID NO: | Formula | Linkage | Site | IR | Sequence | HIR Kd (mol/l) | FFC |
|---|---|---|---|---|---|---|---|---|
| S266 | 1902 | F6 | — | | 2 | Abu-CLEEwGASL-Tic-QCSG | >2 * $10^{-5}$ | 0 |
| S268 | 1903 | F1 | — | | 1 | RD-Hyp-FYDWFDDi | 4.5 * $10^{-7}$ | 0 |
| S273 | 1904 | F1-F2 | C-N | | 1-1 | FHENFYDWFVRQVSKK-Lig-14-Lig-SDGFYNAIELLS | 1.5 * $10^{-6}$ | + |
| S278 | 1905 | F1-derived | — | | 1 | GFREGQRWYWFVAQVT | >2 * $10^{-5}$ | 0 |
| S281 | 1906 | F5 | — | | | DLRVLCELFGGAYVLGYCSE | 1.1 * $10^{-5}$ | 0 |
| S282 | 1907 | F4-derived | — | | | HLSVGEELSWWVALLGQWAR | >2 * $10^{-5}$ | 0 |
| S283 | 1908 | F4-derived | — | | | APVSTEELRWGALLFGQWAG | >2 * $10^{-5}$ | 0 |
| S284 | 1909 | F6-derived | — | | | ALEEEWAWVQVRSIRSGLPL | >2 * $10^{-5}$ | 0 |
| S285 | 1910 | F6-derived | — | | | WLEHEWAQIQCELYGRGCTY | 8.3 * $10^{-7}$ | 0 |
| S287 | 1911 | F1 | — | | 1 | QAPSNFDWFVREWDEE | 5.9 * $10^{-6}$ | 0 |
| S288 | 1912 | F2 | — | | 1 | QSFYDYIEELLGGEWKK | 4.3 * $10^{-6}$ | 0 |
| S289 | 1913 | F2 | — | | 1 | DPFYQGLWEWLRESGEE | >2 * $10^{-5}$ | 0 |
| S290 | 1914 and 1915 | F1-F1 | N-N | | 1-1 | 7-(Lig-GGGFHENFYDWFVRQVSKK)$_2$ | 9.0 * $10^{-7}$ | ++ |
| S291 | 1916 and 1917 | F1-F1 | N-N | | 1-1 | 9-(Lig-GGGFHENFYDWFVRQVSKK)$_2$ | 1.2 * $10^{-6}$ | +++ |
| S292 | 1918 and 1919 | F1-F1 | N-N | | 1-1 | 12-(Lig-GGGFHENFYDWFVRQVSKK)$_2$ | 7.5 * $10^{-7}$ | ++ |
| S293 | 1920 and 1921 | F1-F1 | N-N | | 1-1 | 13-(Lig-GGGFHENFYDWFVRQVSKK)$_2$ | 1.2 * $10^{-7}$ | ++ |
| S294 | 1922 | F1 | — | | 1 | DWLQRNANFYDWFVAEL-Lig | 1.3 * $10^{-7}$ | + |
| S295 | 1923 | F1 | — | | 1 | Lig-DWLQRNANFYDWFVAEL | 4.8 * $10^{-7}$ | 0 |
| S300 | 1924 and 1925 | F1-F1 | C-C | | 1-1 | (DWLQRNANFYDWFVAEL-Lig')$_2$-14 | 5.0 * $10^{-8}$ | +++ |
| S301 | 1926 and 1927 | F1-F1 | N-N | | 1-1 | 14-(Lig'-DWLQRNANFYDWFVAEL)$_2$ | 6.4 * $10^{-7}$ | + |
| S302 | 1928 | F2 | — | | 1 | SDGFYNA-Acy-ELLSG | 8.6 * $10^{-6}$ | 0 |
| S303 | 1929 | F2 | — | | 1 | SGPFYEE-Acy-ELLW-Aib-G | 5.7 * $10^{-6}$ | 0 |
| S304 | 1930 | F2 | — | | 1 | GGSFYDD-Acy-E-Aib-LW-Aib-G | 2.1 * $10^{-5}$ | 0 |
| S305 | 1931 | F2 | — | | 1 | N-Aib-PFYDE-Acy-DE-Cha-W-Aib-G | 8.4 * $10^{-7}$ | 0 |
| S306 | 1932 | F1 | — | | 1 | GRVDWLQRNANFYDWFVAE-Acy-G | 2.2 * $10^{-6}$ | ++ |
| S312 | 1933 and 1934 | F1-F1 | N-N | | 1-1 | 23-(Lig'-GGGFHENFYDWFVRQVSKK)$_2$ | 2.9 * $10^{-7}$ | ++ |
| S313 | 1935 and 1936 | F2-F2 | C-C | | 1-1 | (SDGFNAIELLS-Lig')$_2$-23 | 2.4 * $10^{-7}$ | |
| S315 | 1937 | F1 | — | | 1 | WFYDWFWE | 6.8 * $10^{-6}$ | 0 |
| S316 | 1938 | F10 | — | | 1 | WQGYAWLS | 7.0 * $10^{-6}$ | 0 |
| S317 | 1939 | F10 | — | | 1 | WPGYAWLS | >2 * $10^{-5}$ | 0 |
| S319 | 1940 | F1 | — | | 1 | D-Aic-D-Aib-EFYDWFDEiPq | 8.7 * $10^{-7}$ | 0 |
| S320 | 1941 | F1 | — | | 1 | KNNKEFYEWFDEiGq | 2.8 * $10^{-6}$ | 0 |
| S321 | 1942 | F1 | — | | 1 | YeRD-Hyp-FYDWFDEiGq | 1.4 * $10^{-6}$ | 0 |
| S322 | 1943 | F1 | — | | 1 | EWRD-Hyp-FYDWFDEi-Hyp-e | 7.2 * $10^{-7}$ | 0 |
| S325 | 1944 and 1945 | F1-F1 | N-N | | 1-1 | 9-(Lig'-GSLDESFYDWFERQLGKK)$_2$ | 4.6 * $10^{-8}$ | +++++ |
| S326 | 1600 | F1 | — | | 1 | GIISQSCPESFYDWFAGQVSDPWWCW | 5.9 * $10^{-7}$ | — |
| S327 | 1946 | F2 | — | | 1 | TFYSCLASLLTGTPQPNRGPWERCRKK | 2.1 * $10^{-7}$ | — |
| S329 | 1947 and 1948 | F1-F1 | N-N | | 1-1 | 17-(Lig'-FHENFYDWFVRQVSKK)$_2$ | 2.7 * $10^{-6}$ | ++ |
| S331 | 1949 | F4 | — | | 2 | KHLCVLEELFWGASLFGYCSGKK | 1.6 * $10^{-6}$ | 0 |
| S332 | 1950 and 1951 | F1-F1 | C-C | | 1-1 | (GSLDESFYDWFERQLGKK-Lig')$_2$-9 | 2.1 * $10^{-8}$ | +++++ |
| S333 | 1952 and 1953 | F1-F1 | N-N | | 1-1 | 22-(Lig'-GSLDESFYDWFERQLGKK)$_2$ | 1.4 * $10^{-7}$ | +++ |
| S334 | 1954 and 1955 | F1-F1 | C-C | | 1-1 | 22-(Lig'-GGGFHENFYDWFVRQVSKK)$_2$ | 1.6 * $10^{-6}$ | +++ |
| S335 | 1956 and 1957 | F1-F1 | C-C | | 1-1 | (GSLDESFYDWFERQLGKK-Lig')$_2$-22 | 9.8 * $10^{-8}$ | +++ |
| S336 | 1958 and 1959 | F1-F1 | N-N | | 1-1 | 23-(Lig'-GSLDESFYDWFERQLGKK)$_2$ | 1.5 * $10^{-7}$ | +++ |
| S337 | 1960 and 1961 | F1-F1 | C-C | | 1-1 | (GSLDESFYDWFERQLGKK-Lig')$_2$-23 | 1.1 * $10^{-8}$ | +++++ |
| S342 | 1962 | F1 | — | | 1 | DLWFNAKEDMNFYDWFVWQLR | 1.8 * $10^{-6}$ | 0 |
| S344 | 1963 | F2 | — | | 1 | EHWNIVDPFYHWISELLRESGA | 2.0 * $10^{-6}$ | 0 |
| S345 | 1964 | F2 | — | | 1 | EHWNIVDPFYQYFAELLRESGA | 2.9 * $10^{-6}$ | 0 |
| S349 | 1965 and 1966 | F1-F1 | N-N | | 1-1 | 23-(Lig'-GGGFHENFYDWFVRQVSKK)$_2$-21 | 1.3 * $10^{-7}$ | +++ |
| S350 | 1967 and 1968 | F1-F1 | C-C | | 1-1 | (GSLDESFYDWFERQLGKK-Lig')$_2$-21 | 4.7 * $10^{-7}$ | +++++ |

TABLE 7-continued

| Peptide | SEQ ID NO: | Formula | Linkage | Site | IR | Sequence | HIR Kd (mol/1) | FFC |
|---|---|---|---|---|---|---|---|---|
| S351 | 1969 and 1970 | F1-F1 | N-N | | 1-1 | 21-(Lig'-GSLDESFYDWFERQLGKK)$_2$ | $1.4 * 10^{-6}$ | +++ |
| S352 | 1971 and 1972 | F1-F1 | N-N | | 1-1 | 21-(Lig'-GGGFHENFYDWFVRQVSKK)$_2$ | $6.6 * 10^{-7}$ | +++ |
| S353 | 1973 and 1974 | F1-F1 | C-C | | 1-1 | (GSLDESFYDWFERQLGKK-Lig')$_2$-14 | $1.1 * 10^{-8}$ | +++++ |
| S354 | 1975 and 1976 | F1-F1 | N-N | | 1-1 | 14-(Lig'-GSLDESFYDWFERQLGKK)$_2$ | $3.9 * 10^{-7}$ | ++++ |
| S359 | 1977 and 1978 | F1-F1 | N-N | | 1-1 | 9-(Lig'-DWLQRNANFYDWFVAEL)$_2$ | $7.0 * 10^{-7}$ | + |
| S360 | 1979 and 1980 | F1-F1 | N-N | | 1-1 | 23-(Lig'-DWLQRNANFYDWFVAEL)$_2$ | $9.9 * 10^{-7}$ | |
| S361 | 1981 and 1982 | F1-F1 | C-C | | 1-1 | (GSLDESFYDWFERQLGKK-Lig')$_2$-24 | $2.2 * 10^{-6}$ | +++ |
| S362 | 1983 and 1984 | F1-F1 | N-N | | 1-1 | 24-(Lig'-GSLDESFYDWFERQLGKK)$_2$ | $1.1 * 10^{-7}$ | +++ |
| S363 | 1985 and 1986 | F1-F1 | N-N | | 1-1 | 24-(Lig'-GGGFHENFYDWFVRQVSKK)$_2$ | $2.2 * 10^{-7}$ | +++ |
| S365 | 1987 | F1 | — | | 1 | RMYFSTGAPQNFYDWFVQEWD | $1.0 * 10^{-5}$ | 0 |
| S366 | 1988 | F1 | — | | 1 | PLRESRNFYDWFVQQLE | $3.7 * 10^{-7}$ | 0 |
| S368 | 1989 | F2 | — | | 1 | RGTRSDPFYHKLSELLQGH | $>2 * 10^{-5}$ | 0 |
| S371 | 1558 | F1 | — | | 1 | GSLDESFYDWFERQLGKK | $6.3 * 10^{-7}$ | + |
| S372 | 1990 | F1 | — | | 1 | SGSLDESFYDWFERQLGKK | $2.0 * 10^{-7}$ | ++ |
| S373 | 1991 | F1 | — | | 1 | GSLDESFYDWFERQLGKKK(S) | $1.2 * 10^{-7}$ | +++ |
| S374 | 1992 and 1993 | F1-F1 | N-N | | 1-1 | 17-(Ald-GSLDESFYDWFERQLGKK)$_2$ | $1.8 * 10^{-7}$ | ++++ |
| S375 | 1994 | F1 | C-N | | 1-1 | (GSLDESFYDWFERQLGKKK-Ald)-14-(Ald-GSLDESFYDWFERQLGKK) | $2.0 * 10^{-7}$ | ++++ |
| S376 | 1995 and 1996 | F1-F1 | N-N | | 1-1 | 19-(Ald-GSLDESFYDWFERQLGKK)$_2$ | $1.6 * 10^{-7}$ | +++++ |
| S378 | 1997 and 1998 | F1-F1 | C-C | | 1-1 | (GSLDESFYDWFERQLGKKK-Ald)$_2$-17 | $6.5 * 10^{-8}$ | +++++ |
| S379 | 1999 and 2000 | F1-F1 | C-C | | 1-1 | (GSLDESFYDWFERQLGKKK-Ald)$_2$-19 | $5.6 * 10^{-8}$ | ++++ |
| S380 | 2001 and 2002 | F1-F1 | C-C | | 1-1 | (EEDWLQRNANFYDWFVAEL-Lig')$_2$-9 | $5.1 * 10^{-7}$ | ++ |
| S381 | 2003 and 2004 | F1-F1 | C-C | | 1-1 | (EEDWLQRNANFYDWFVAEL-Lig')$_2$-23 | $1.2 * 10^{-7}$ | +++ |
| S386 | 1559 | F1 | — | | 1 | GSLDESFYDWFERQLG | $3.2 * 10^{-7}$ | + |
| S387 | 2005 | F1 | — | | 1 | SLDESFYDWFERQLG | $6.3 * 10^{-7}$ | + |
| S388 | 2006 | F1 | — | | 1 | LDESFYDWFERQLG | $3.4 * 10^{-7}$ | + |
| S389 | 2007 | F1 | — | | 1 | DESFYDWFERQLG | $1.1 * 10^{-6}$ | + |
| S390 | 1794 | F1 | — | | 1 | ESFYDWFERQLG | $6.2 * 10^{-7}$ | + |
| S391 | 2008 | F1 | — | | 1 | SFYDWFERQLG | $1.5 * 10^{-6}$ | + |
| S392 | 2009 | F1 | — | | 1 | FYDWFERQLG | $3.8 * 10^{-6}$ | 0 |
| S394 | 1788 | F1 | — | | 1 | GSLDESFYDWFERQ | $9.1 * 10^{-8}$ | + |
| S395 | 1787 | F1 | — | | 1 | GSLDESFYDWFERQL | $8.1 * 10^{-8}$ | ++ |
| S396 | 1789 | F1 | — | | 1 | GSLDESFYDWFER | $>2 * 10^{-5}$ | 0 |
| S397 | 2010 | F1 | — | | 1 | GSLDESFYDWFE | $>2 * 10^{-5}$ | 0 |
| S398 | 2011 | F1 | — | | 1 | GSLDESFYDWF | $>2 * 10^{-5}$ | 0 |
| S399 | 1790 | F1 | — | | 1 | ESFYDWFERQL | $9.5 * 10^{-8}$ | ++ |
| S400 | 1791 | F1 | — | | 1 | ESFYDWFERQ | $6.3 * 10^{-7}$ | 0 |
| S401 | 2012 | F1 | — | | 1 | ESFYDWFER | $>2 * 10^{-5}$ | 0 |
| S402 | 2013 | F1 | — | | 1 | ESFYDWFE | $>2 * 10^{-5}$ | 0 |
| S403 | 2014 | F1 | — | | 1 | ESFYDWF | $>2 * 10^{-5}$ | 0 |
| S414 | 2015 and 2016 | F1-F1 | C-C | | 1-1 | (ESFYDWFERQLGK-Lig')$_2$-14 | $3.8 * 10^{-7}$ | ++++ |
| S415 | 2017 and 2018 | F1-F1 | C-C | | 1-1 | (ESFYDWFERQLGK-Lig')$_2$-23 | $1.0 * 10^{-7}$ | +++ |
| S416 | 2019 and 2020 | F1-F1 | N-N | | 1-1 | 14-(Lig'-ESFYDWFERQLG)$_2$ | $9.3 * 10^{-7}$ | +++ |
| S417 | 2021 and 2022 | F1-F1 | N-N | | 1-1 | 23-(Lig'-ESFYDWFERQLG)$_2$ | $9.2 * 10^{-7}$ | ++++ |
| S418 | 2023 and 2024 | F1-F1 | C-C | | 1-1 | (ESFYDWFERQLGK-Ald)$_2$-17 | $1.2 * 10^{-7}$ | ++++ |
| S419 | 2025 and 2026 | F6-F6 | N-N | | 2-2 | 14-(Lig'-EWLDQEWAWVQCEVYGRGCPSEE)$_2$ | | 0 |
| S420 | 2027 and 2028 | F1-F1 | N-N | | 1-1 | 17-(Ald-ESFYDWFERQLG)$_2$ | | ++ |
| S423 | 2029 and 2030 | F1-F8 | C-C | | 1-3 | ESFYDWFERQLG<br>K | $6.2 * 10^{-8}$ | 0 |
| S425 | 2031 | F1-F6 | C-N | | 1-2 | ACAWPTYWNCG<br>GSLDESFYDWFERQLGKK-Lig'-14-Lig'-EWLDQEWAWVQCEVYGRGCPSEE | $2.4 * 10^{-9}$ | — |

TABLE 7-continued

| Peptide | SEQ ID NO: | Formula | Linkage | Site IR | Sequence | HIR Kd (mol/l) | FFC |
|---|---|---|---|---|---|---|---|
| S429 | 2032 | F6-F1 | C-N | 2-1 | EWLDQEWAWVQCEVYGRGCPSEE-Lig'-14-Lig'-GSLDESFYDWFERQLGKK | $6.0 * 10^{-10}$ | |
| S432 | 2033 and 2034 | F1-F6 | C-C | 1-2 | ESFYDWFERQLGGGG<br>K | $1.8 * 10^{-7}$ | + |
| S433 | 2035 and 2036 | F1-F6 | C-C | 1-2 | CEVYGRGCPS<br>ESFYDWFERQLGGGG<br>K | $1.1 * 10^{-7}$ | + |
| S436 | 2037 and 2038 | F1-F6 | C-C | 1-2 | WLDQEWAWVQ<br>ESFYDWFERQLGGGG<br>K | $5.2 * 10^{-10}$ | +++ |
| S437 | 2039 and 2040 | F1-F6 | C-C | 1-2 | WLDQEWAWVQCEVYGRGCPS<br>ESFYDWFERQLGGGG<br>K | $6.9 * 10^{-10}$ | +++ |
| S438 | 2041 and 2042 | F1-F6 | C-C | 1-2 | LDQEWAWVQCEVYGRGCPS<br>ESFYDWFERQLGGGG<br>K | $3.0 * 10^{-8}$ | ++ |
| S439 | 2043 and 2044 | F1-F6 | C-C | 1-2 | DQEWAWVQCEVYGRGCPS<br>ESFYDWFERQLGGGG<br>K | $4.6 * 10^{-8}$ | |
| S440 | 2045 and 2046 | F1-F6 | C-C | 1-2 | QEWAWVQCEVYGRGCPS<br>ESFYDWFERQLGGGG<br>K | $9.9 * 10^{-8}$ | |
| S441 | 2047 and 2048 | F1-F6 | C-C | 1-2 | EWAWVQCEVYGRGCPS<br>ESFYDWFERQLGGGG<br>K | $1.2 * 10^{-7}$ | |
| S442 | 2049 and 2050 | F1-F6 | C-C | 1-2 | WAWVQCEVYGRGCPS<br>ESFYDWFERQLGGGG<br>K | $1.6 * 10^{-7}$ | |
| S443 | 2051 and 2052 | F1-F6 | C-C | 1-2 | AWVQCEVYGRGCPS<br>ESFYDWFERQLGGGG<br>K | $1.7 * 10^{-7}$ | |
| S444 | 2053 and 2054 | F1-F6 | C-C | 1-2 | WVQCEVYGRGCPS<br>ESFYDWFERQLGGGG<br>K | $1.9 * 10^{-7}$ | |
| S445 | 2055 and 2056 | F1-F6 | C-C | 1-2 | VQCEVYGRGCPS<br>ESFYDWFERQLGGGG<br>K | $2.3 * 10^{-7}$ | |
| S453 | 2057 | F1-F6 | C-N | 1-2 | QCEVYGRGCPS<br>GSLDESFYDWFERQLGKKK-Ald-17-Ald-KEWLDQEWAWVQCEVYGRGCPSEE | $5.7 * 10^{-10}$ | – |
| S454 | 2058 and 2059 | F1-F6 | C-C | 1-2 | GSLDESFYDWFERQLGKKK-Ald<br>17 | $3.8 * 10^{-10}$ | +++ |
| S455 | 2060 | F6-F1 | C-N | 2-1 | EWLDQEWAWVQCEVYGRGCPSEEK-Ald<br>17 | $1.1 * 10^{-9}$ | ++++ |
| S456 | 2061 and 2062 | F1-F6 | N-N | 1-2 | EWLDQEWAWVQCEVYGRGCPSEEK-Ald-18-Ald-GSLDESFYDWFERQLGKK<br>Ald-GSLDESFYDWFERQLGKK<br>17<br>Ald-KEWLDQEWAWVQCEVYGRGCPSEE | $2.4 * 10^{-9}$ | +++ |
| S457 | 2063 | F6-F1 | C-N | 2-1 | WLDQEWAWVQCEVYGRGCPSGGSGGSGGSLLDESFYDWFERQLG | $1.6 * 10^{-9}$ | ++++ |
| S458 | 2064 | F6-F1 | C-N | 2-1 | WLDQEWAWVQCEVYGRGCPSGGSGGSGGSLDESFYDWFERQLG | $3.2 * 10^{-9}$ | ++++ |
| S459 | 2065 | F1-F6 | C-N | 1-2 | GSLDESFYDWFERQLGGGSGGSGGSWLDQEWAWVQCEVYGRGCPS | $7.6 * 10^{-11}$ | – |
| S467 | 2066 | F6-F1 | C-N | 2-1 | EWLDQEWAWVQCEVYGRGCPSEEK-Ald-16-Ald-GSLDESFYDWFERQLGKK | $6.8 * 10^{-10}$ | ++++ |
| S468 | 2067 | F6-F1 | C-N | 2-1 | EWLDQEWAWVQCEVYGRGCPSEEK-Ald-19-Ald-GSLDESFYDWFERQLGKK | $4.0 * 10^{-10}$ | ++++ |

TABLE 7-continued

| Peptide | SEQ ID NO: | Formula | Linkage | Site | IR | Sequence | HIR Kd (mol/1) | FFC |
|---|---|---|---|---|---|---|---|---|
| S471 | 2068 | F6-F1 | C-N | | 2-1 | LDQEWAWVQCEVYGRGCPSESFYDWFERQLG | 6.7 * 10$^{-10}$ | ++++ |
| S481 | 2069 | F6-F1 | C-N | | 2-1 | HHHHHHKLDQEWAWVQCEVYGRGCPSESFYDWFERQLG | | |
| S482 | 2070 | F6-F1 | C-N | | 2-1 | LDQEWAWVQCEVYGRGCPSESFYDWFERQLG | | 0 |
| S483 | 2071 | F6-F1 | C-N | | 2-1 | LDEWAWVQCVEYGRGCPSESFYDWFERQLG | 5.2 * 10$^{-8}$ | 0 |
| S484 | 2072 | F6-F1 | C-N | | 2-1 | LDQEWAVQCEVYGRGCPSESFYDWFERQLG | 8.7 * 10$^{-8}$ | 0 |
| S485 | 2073 | F6-F1 | C-N | | 2-1 | LDQEWAWVCEVYGRGCPSESFYDWFERQLG | 1.6 * 10$^{-7}$ | 0 |
| S486 | 2074 | F6-F1 | C-N | | 2-1 | LDQEWAWVQCVYGRGCPSESFYDWFERQLG | 5.7 * 10$^{-8}$ | 0 |
| S487 | 2075 | F6-F1 | C-N | | 2-1 | LDQEWAWVQCEVYGRCPSESFYDWFERQLG | | |
| S488 | 2076 | F6-F1 | C-N | | 2-1 | LDQEWAWVQCEVYGRGCSESFYDWFERQLG | | |
| S489 | 2077 | F6-F1 | C-N | | 2-1 | LDQEWAWVQCEVYGRGCPEFYDWFERQLG | | |
| S490 | 2078 | F6-F1 | C-N | | 2-1 | LDQEWAWVQCEVYGRGCESFYDWFERQLG | | |
| S491 | 2079 | F6-F1 | C-N | | 2-1 | LDQEWAWVQCEVYGRGCPSEFYDWFERQLG | | |
| S492 | 2080 | F6-F1 | C-N | | 2-1 | LDQEWAWVQCEVYGRGCPSESFYDWFRQLG | | |
| S493 | 2081 | F6-F1 | C-N | | 2-1 | EWLDQEWAWVQCEVYGRGCPSEE-POX-Lys(biotin) | | |
| S494 | 2082 | F6-F1 | C-N | | 2-1 | ADQEWAWVQCEVYGRGCPSESFYDWFERQLG | 1.7 * 10$^{-8}$ | + |
| S495 | 2083 | F6-F1 | C-N | | 2-1 | LAQEWAWVQCEVYGRGCPSESFYDWFERQL | | |
| S496 | 2084 | F6-F1 | C-N | | 2-1 | LDAEWAWVQCEVYGRGCPSESFYDWFERQL | | |
| S497 | 2085 | F6-F1 | C-N | | 2-1 | LDQAWAWVQCEVYGRGCPSESFYDWFERQL | 2.5 * 10$^{-9}$ | +++ |
| S498 | 2086 | F6-F1 | C-N | | 2-1 | LDQEAWVQCEVYGRGCPSESFYDWFERQL | 5.6 * 10$^{-8}$ | + |
| S499 | 2087 | F6-F1 | C-N | | 2-1 | LDQEWAAVQCEVYGRGCPSESFYDWFERQL | 6.2 * 10$^{-10}$ | ++++ |
| S500 | 2088 | F6-F1 | C-N | | 2-1 | LDQEWAWAQCEVYGRGCASESFYDWFERQL | | |
| S501 | 2089 | F6-F1 | C-N | | 2-1 | LDQEWAWVACEVYGRGCPSESFYDWFERQL | | |
| S502 | 2090 | F6-F1 | C-N | | 2-1 | LDQEWAWVQCAVYGRGCPSESFYDWFERQL | 3.0 * 10$^{-9}$ | +++ |
| S503 | 2091 | F6-F1 | C-N | | 2-1 | LDQEWAWVQCEAYGRGCPSESFYDWFERQL | | |
| S504 | 2092 | F6-F1 | C-N | | 2-1 | LDQEWAWVQCEVAGRGCPSESFYDWFERQL | | |
| S505 | 2093 | F6-F1 | C-N | | 2-1 | LDQEWAWVQCEVYARGCPSESFYDWFERQL | | |
| S506 | 2094 | F6-F1 | C-N | | 2-1 | LDQEWAWVQCEVYGAGCPSESFYDWFERQL | | |
| S507 | 2095 | F6-F1 | C-N | | 2-1 | LDQEWAWVQCEVYGRACPSESFYDWFERQL | | |
| S508 | 2096 | F6-F1 | C-N | | 2-1 | LDQEWAWVQCEVYGRGCASESFYDWFERQL | | |
| S509 | 2097 | F6-F1 | C-N | | 2-1 | LDQEWAWVQSEVYGRGSPSESFYDWFERQL | | |
| S510 | 2098 | F6-F1 | C-N | | 2-1 | SLEEEWAQVECEVYGRGCPSGGSGGSGLLDESFYHWFDRQLR | 6.2 * 10$^{-11}$ | +++++ |
| S511 | 2099 | F6-F1 | C-N | | 2-1 | WLDQEWAWVQCEVYGRGCPSGGSGGSGGRVDWLQRNANFYDWFVAELG | 3.8 * 10$^{-9}$ | ++ |
| S512 | 2100 | F6-F1 | C-N | | 2-1 | WLDQEWAWVQCEVYGRGCPSGGSGGSSQAGSAFYAWFDQVLRTV | 2.8 * 10$^{-8}$ | ++ |
| S513 | 2101 | F4-F1 | C-N | | 2-1 | WLDQEWAWVQCEVYGRGCPSGGSGGSQSDAFYSGLMALIGLSDG | | |
| S515 | 2102 | F6 | — | | 2 | LDQEWAMVQCEVYGRGCPSPOX-Lys(Biotin) | | |
| S516 | 2103 | F4-F1 | C-N | | 2-1 | H-Acy-CLEEwGASL-Tic-QCSGSESFYDWFERQL | | |
| S517 | 2104 | F6-F1 | C-N | | 2-1 | SIEEEWAQIKCDVWGRGCPSESFYDWFERQL | | |
| S518 | 2105 | F6-F1 | C-N | | 2-1 | RLEEEWAQIKCDVWGRGCPSGGSLLDESFYDWFERQLG | 1.6 * 10$^{-10}$ | +++++ |
| S519 | 2106 | F6-F1 | C-N | | 2-1 | SLEEEWAQIKCDVWGRCPSGSLDESFYDWFERQLG | 2.0 * 10$^{-11}$ | +++++++ |
| S520 | 2107 | F6-F1 | C-N | | 2-1 | SIEEEWAQIKCDVWGRGCPGLLDESFYDWFERQLR | 2.0 * 10$^{-11}$ | ++++++ |
| S521 | 2108 | F4-F1 | C-N | | 2-1 | HLCVLEELFWGASLFGYCSGGSLDESFYDWFERQL | 2.7 * 10$^{-8}$ | + |
| S522 | 2109 | F4-F1 | C-N | | 2-1 | HLCVLEELFWGASLFGYCSGGRVDWLQRNANFYDWFVAELG | | |

TABLE 7-continued

| Peptide | SEQ ID NO: | Formula | Linkage | Site IR | Sequence | HIR Kd (mol/l) | FFC |
|---|---|---|---|---|---|---|---|
| S523 | 2110 | F6-F10 | C-N | 2-1 | WLDQEWAWVQCEVYGRGCPSDSDWAGYEWFEEQLD | $4.3 * 10^{-9}$ | ++ |
| S524 | 2111 | F6-F1 | C-N | 2-1 | HHHHHHKSLEEEWAQVECEVYGRGCPSGSLDESFYDWFERQLG | | |

7, 9, 12, 13, 14, 17, 19, 20, 21, 22, 23, and 24 represent specific chemical linkers (see Table 3); For FFC: 0 is no effect, + is agonist, − is antagonist. Peptides listed on 3 lines consist of two different peptides, linked N-N or C-C, either by chemical linkage or by being synthesized on the two branches of an amino acid with two amino groups such as, e.g., lysine. Acy = 1-amino-1-cyclohexanecarboxylic acid; Cha = cyclohexylalanine; Aib = 2-aminoisobutyric acid; Hyp = Hydroxyproline; Amino acids which are not capitalized are D-amino acids; Lig = Diaminopropionic acid with a 2-aminohydroxyacetyl group (CO—CH2—O—NH2) on the side chain amino group; Lig' = lysine with a 2-aminohydroxyacetyl group (CO—CH2—O—NH2) on the side chain amino group; Ald = an aldehyde group obtained by periodate oxidation of a serine, either N-terminal or attached to the side chain amino group of lysine.

Results further indicated that S175–S175 dimer peptides (Site 1-Site 1) were less agonistic than S175 monomer peptides (++vs. +++). S175—S175 dimer peptides having a C—N linkage were less agonistic or equally agonistic as compared to S175—S175 dimer peptides having C—C or N—N linkages. F8-F8 dimer peptides, like the parent monomer, showed no agonist activity.

Example 5

Substrate Phosphorylation Assay (HIR Kinase)

WGA (wheat germ agglutinin)-purified recombinant human insulin receptor was mixed with either insulin or peptide in varying concentrations in substrate phosphorylation buffer (50 mM HEPES (pH 8.0), 3 mM MnCl$_2$, 10 mM MgCl$_2$, 0.05% Triton X-100, 0.1% BSA, 12.5 slM ATP). A synthetic biotinylated substrate peptide (Biotin-KSRGDYMTMQIG) was added to a final concentration of 2 μg/ml. Following a 1 hr incubation at RT, the reactions were stopped by the addition of 50 mM EDTA. The reactions were transferred to Streptavidin coated 96-well microtiter plates (NUNC, Cat. No. 236001) and incubated for 1 hr at RT. The plates were washed 3 times with TBS (10 mM Tris (pH 8.0), 150 mM NaCl).

Subsequently, a 2000-fold dilution of horseradish peroxidase (HRPO) conjugated phosphotyrosine antibody (Transduction Laboratories, Cat. No. E120H) in TBS was added. The plates were incubated for 30 min and washed 3 times with TBS. TMB (3,3',5,5'-tetramethylbenzidine; Kem-En-Tec, Copenhagen, Denmark) was added. One substrate from Kem-En-Tec was added. After $10^{-15}$ min, the reaction was stopped by the addition of 1% acetic acid. The absorbance, representing the extent of substrate phosphorylation, was measured in a spectrophotometer at a wavelength of 450 nM.

The results indicated that the potency of the Site 1-Site 2 dimer, peptide 539, was 0.1 to 1% of that of insulin in all assays tested (Table 8), and the dose-response curves (FIGS. 17A–17B) had a shape similar to that of insulin dose-response curves, suggesting an insulin-like action mechanism. In addition, Site 1-Site 2 dimer peptides 537 and 538 were also active as specific insulin receptor antagonists (Table 8; FIGS. 16A–16C). Notably, Site 2-Site 1 dimer peptide 539 was more active in the kinase assay than Site 1-Site 1 homodimer peptides 521 and 535 (FIGS. 19A–19B), despite lower FFC potency (FIGS. 14A–14C; FIGS. 17A–17B). Similar results are shown in FIGS. 20A–B and FIGS. 21A–B. This data suggested that homodimer and heterodimer peptides used different mechanisms of action.

TABLE 8

| Pep. | Mon./Link. | Sequence | SEQ ID NO: | Form | Site IR | HIR $K_d$ (nM) | HIGF-1R $K_d$ (nM) | FFC Pot. (nM) | Kinase Pot. (nM) |
|---|---|---|---|---|---|---|---|---|---|
| HI | | | | | na | na | | | |
| HIGF-1R | | | | | na | na | | | |
| 521 | RP9-6aa-RP9 | MADYKDDDDKGSLDESFYDWFER QLGKK<u>GGSGGS</u>GSLDESFYDWFE RQLGKKAAA(ETAG)PG | 2112 | 1-1 | 1-1 | 25 | — | A 3 | 1400 |
| 535 | RP9-12aa-RP9 | MADYKDDDDKGSLDESFYDWFER QLGKK<u>GGSGGSGGSGGSGGS</u>GSLDES FYDWFERQLGKKAAA(ETAG)PG | 2113 | 1-1 | 1-1 | 15 | — | A 2 | 1000 |
| 537 | RP9-6aa-D8 | MADYKDDDDKGSLDESFYDWFER QLGKK<u>GGSGGS</u>WLDQEWAWVQC EVYGRGCPSAAA(ETAG)PG | 2114 | 1-6 | 1-2 | 0.092 | 980 | N 10 | Inactive |
| 538 | RP9-12aa-D8 | MADYKDDDDKGSLDESFYDWFER QLGKK<u>GGSGGSGGSGGS</u>WLDQE WAWVQCEVYGRGCPSAAA(ETAG) PG | 2115 | 1-6 | 1-2 | 0.080 | 710 | N 10 | Inactive |
| 539 | D8-6aa-RP9 | MADYKDDDDKWLDQEWAWVQCE VYGRGCPS<u>GGSGGS</u>GSLDESFYD WFERQLGKKAAA(ETAG)PG | 2116 | 6-1 | 2-1 | 0.530 | 1500 | A 10 | 110 |

A = agonist; N = antagonist; na = not applicable; Form. = formula; Mon. = constituent monomers; Link. = linker; Pot. = potency; HI and HIGF-1R are controls; All with tags at both ends; All dimers are linked C-N; Linker sequences are underlined.

Example 6

IR Autophosphorylation Assays

IR activation was assayed by detecting autophosphorylation of an insulin receptor construct transfected into 32D cells (Wang et al., 1993, Science 261:1591–1594; clone 969). The IR transfected 32D cells were seeded at 5×10$^6$ cells/well in 96-well tissue culture plates and incubated overnight at 37° C. Samples were diluted 1:10 in the stimulation medium (PRIM1640 with 25 nM HEPES pH 7.2) plus or minus insulin. The culture media was decanted from the cell culture plates, and the diluted samples were added to the cells. The plates were incubated at 37° C. for 30 min. The stimulation medium was decanted from the plates, and cell lysis buffer (50 mM HEPES pH 7.2, 150 mM NaCl, 0.5% Triton X-100, 1 mM AEBSF, 10 KIU/ml aprotinin, 50 μM leupeptin, and 2 mM sodium orthovanadate) was added. The cells were lysed for 30 min.

In the ELISA portion of the assay, the cell lysates were added to the BSA-blocked anti-IR unit mAb (Upstate Biotechnology, Lake Placid, N.Y.) coated ELISA plates. After a 2 hr incubation, the plates were washed 6 times with PBST and biotinylated anti-phosphotyrosine antibody (Upstate Biotechnology) is added. After another 2 h incubation, the plates were again washed 6 times. Streptavidin-Eu was then added, and the plates were incubated for 1 h. After washing the plates again, EG&G Wallac enhancement solution (100 mM acetone-potassium hydrogen pthalate, pH 3.2; 15 mM 2-naphtyltrifluoroacetate; 50 mM tri(n-octylyphosphine oxide; 0.1% Triton X-100) was added into each well, and the plates were placed onto a shaker for 20 min at RT. Fluorescence of samples in each well was measured at 615 nm using a VICTOR 1420 Multilabel Counter (EG&G Wallac).

Alternatively, IR autophosphorylation was determined using a holoenzyme phosphorylation assay. In accordance with this assay, 1 µl of purified insulin receptor (isolated from a Wheat Germ Agglutinin Expression System) was incubated with 25 nM insulin, or 10 or 50 µM peptide in 50 µl autophosphorylation buffer (50 mM HEPES pH. 8.0, 150 mM NaCl, 0.025% Triton-X-100, 5 mM MnCl$_2$, 50 µM sodium orthovanadate) containing 10 µM ATP for 45 min at 22° C. The reaction was stopped by adding 50 µl of gel loading buffer containing β-mercaptoethanol (Bio-Rad Laboratories, Inc., Hercules, Calif.). The samples were run on 4–12% SDS-polyacrylamide gels. Western Blot analysis was performed by transferring the proteins onto nitrocellulose membrane. The membrane was blocked in PBS containing 3% milk overnight. The membrane was incubated with anti-phosphotyrosine 4 Gb0 HRP labeled antibody (Upstate Biotechnology) for 2 h. Protein bands were visualized using SuperSignal West Dura Extended Duration Substrate Chemiluminescence Detection System (Pierce Chemical Co.).

Example 7

Fluorescence-Based HIR Binding Assays

A. Time-Resolved Fluorescence Resonance Energy Transfer Assays

Time-resolved fluorescence resonance energy transfer assays (TR-FRET) were used for peptide competition studies. In one set of assays, monomer and dimer peptides were tested for the ability to compete with biotinylated RP-9 monomer peptide (b-RP9) for binding to HIR-immunoglobulin heavy chain chimera (sIR-Fc; Bass et al., 1996). The assays were performed using a 384-well white microplate (NUNC) with a final volume of 30 HI. Final incubation conditions were in 22 nM bRP9, 1 nM SA-APC (streptavidin-allophycocyanin), 1 nM Eu$^{3+}$-sIR-Fc (LANCE™ labeled, PE Wallac, Inc.), 0.05 M Tris-HCl (pH 8 at 25° C.), 0.138 M NaCl, 0.0027 M KCl, and 0.1% BSA (Cohn Fraction V). After 16–24 hr of incubation at RT, the fluorescence signal at 665 nm and 620 nm was read on a Victor$^2$ 1420 plate reader (PE Wallac, Inc.). Primary data were background corrected, normalized to buffer controls, and then expressed as percent of specific binding.

Results are shown in FIGS. 22A–22B. FIG. 21A shows bRP9 competition data. For these figures, the Z'-factor was greater than 0.5 (Z'1-(3σ$_{+3}$σ_)/|µ$_{+}$_µ|; Zhang et al., 1999, J. Biomol. Screen. 4:67–73), and the signal-to-background (S/B) ratio was ~4–5. In FIG. 22A, each data point represents the average of two replicate wells. The lines represent the best fit to a four-parameter non-linear regression analysis of the data according to the following formula: y=min+(max−min)/(1+10^((logIC$_{50}$−x)*Hillslope)). This was used to determine IC$_{50}$ values.

In another set of assays, monomer and dimer peptides were tested for the ability to compete with biotinylated-S175 (b-S175) or b-RP9 for binding to sIR-Fc. The TR-FRET assays were performed in a 384-well white microplate with a final volume of 30 µl. Final incubation conditions were in 33 nM b-S175 or 22 nM bRP9, 1 nM SA-APC, 1 nM Eu$^3$_-sIR-Fc, 0.05 M Tris-HCl (pH 8 at 25° C.), 0.138 M NaCl, 0.0027 M KCl, and 0.1% BSA. After 16–24 hr of incubation at RT, the fluorescence signal at 665 nm and 620 nm was read on a Victor$^2$ 1420 plate reader. Primary data were background corrected, normalized to buffer controls, and then expressed as % Specific Binding.

Results are shown in FIGS. 23A–23B. For these figures, each data point represents the average of two replicate wells. The lines represent the best fit to a four-parameter non-linear regression analysis of the data, which was used to determine IC$_{50}$ values. FIG. 23A shows b-S175 competition data; FIG. 23B shows b-RP9 competition data.

B. Fluorescence Polarization Assays

Fluorescence polarization assays (FP) were used for peptide competition studies. In one set of assays monomer and dimer peptides were tested for the ability to compete with fluorescein-RP-9 (FITC-RP9) for binding to soluble HIR ectodomain (sIR; Kristensen et al., 1998, J. Biol. Chem. 273:17780–17786). The assays were performed in a 384-well black microplate (NUNC) with a final volume of 30 jpl. Final incubation conditions were 1 nM FITC-RP9, 10 nM sIR, 0.05 M Tris-HCl (pH 8 at 250° C.), 0.138 M NaCl, 0.0027 M KCl, 0.05% BGG (bovine gamma globulin), 0.005% Tween-209. After 16–24 hr of incubation at RT, the fluorescence signal at 520 nm was read on an Analyst™ AD plate reader (LJL BioSystems, Inc.). Primary data were background corrected using 10 nM sIR without FITC-RP9 addition, normalized to buffer controls, and then expressed as percent of specific binding. The Z'-factor was greater than 0.5 and the assay dynamic range was −125 mP. In FIGS. 24–27, each data point represents the average of two replicate wells. The lines represent the best fit to a four-parameter non-linear regression analysis of the data, which was used to determine IC$_{50}$ values. The Z'-factor was greater than 0.5 and the assay dynamic range was ~125 mP. Results are shown in FIGS. 24A–24B.

In another set of assays, monomer and dimer peptides were tested for the ability to compete with FITC-RP9 for binding to soluble human insulin mini-receptor (mlR; Kristensen et al., 1999, J. Biol. Chem. 274:37351–37356). The FP assays were performed in a 384-well black microplate with a final volume of 30 µl. Final incubation conditions were 2 nM FITC-RP9, 20 nM mIR, 0.05 M Tris-HCl (pH 8 at 25° C.), 0.138 M NaCl, 0.0027 M KCl, 0.001% BGG, 0.005% Tween-200®. After 16–24 hr of incubation at RT, the fluorescence signal at 520 nm was read on an Analyst™ AD plate reader. Primary data were background corrected using 20 nM mIR without FITC-RP9 addition, normalized to buffer controls and then expressed as percent of specific binding. Results are shown in FIGS. 25A–25B.

Monomers and dimer peptides were also tested for the ability to compete with fluorescein-insulin (FITC-lnsulin) for binding to sIR. The FP assays were performed in a 384-well black microplate with a final volume of 30 µl. Final incubation conditions were in 2 nM FITC-lnsulin, 20 nM sIR, 0.05 M Tris-HCl (pH 8 at 25° C.), 0.138 M NaCl, 0.0027 M KCl, 0.05% BGG, 0.005% Tween-200. After 16–24 hr of incubation at RT, the fluorescence signal at 520 nm was read on an Analyst™ AD plate reader. Primary data were background corrected using 20 nM sIR without FITC-lnsulin addition, normalized to buffer controls and then expressed as percent of specific binding. Results are shown in FIGS. 26A–26B.

In other assays, peptide monomers and dimer peptides were tested for the ability to compete with FITC-lnsulin for binding to mIR. The FP assays were performed in a 384-well black microplate with a final volume of 30 μl. Final incubation conditions were 2 nM FITC-lnsulin, 20 nM mIR, 0.05 M Tris-HCl (pH 8 at 250° C.), 0.138 M NaCl, 0.0027 M KCl, 0.05% BGG (bovine gamma globulin), 0.005% Tween-20®. After 16–24 hr of incubation at RT, the fluorescence signal at 520 nm was read on an Analysts™ AD plate reader. Primary data were background corrected using 20 nM mIR without FITC-RP9 addition, normalized to buffer controls and then expressed as % Specific Binding. Results are shown in FIGS. 27A–27B.

C. Summary

Table 9, below, summarizes the binding data calculated from competition assays using the IR constructs, sIR-Fc, sIR, and mIR, in TR-FRET and FP formats. The data in Table 9 indicate that most dimer peptides (e.g., S291 and S375 or S337), showed greater agonist activity than the corresponding monomer peptides (e.g., $H_2C$ or RP9, respectively) in the FFC assay. It was previously demonstrated that an inequality between monomer peptides and insulin was exhibited in competition assays where the assay reporter was a monomer peptide (i.e., RP9 or Si 75). This inequality was also demonstrated by dimer peptides as seen in Table 9. Table 9 further shows that Group 6 monomer peptides such as E8 (D120) were able to compete with FITC-RP9 or b-RP9 peptides for binding to sIR-Fc, but did not compete peptide ligands, such as FITC-RP9 for binding to mIR. Experiments using different IR constructs thereby allowed differentiation of Site I peptides based on sequence motifs (i.e., Group 6 (Formula 10) vs. Group 1 (Formula 1; A6)).

TABLE 9

| Monomer or Dimer | SEQ ID NO: | Linkage | Label⇒ Sequence | sIR-Fc b-S175 FRET IC50 (nM) | Hill | IR-Fc b-RP9 FRET IC50 (nM) |
|---|---|---|---|---|---|---|
| H2C | 2117 | | FHENFYDWFVQRVSKK | 410 | −0.82 | 1626 |
| S291 | 1916 and 1917 | N-N | (Lig-GGG-H2C)₂-9 | 81 | −0.96 | 250 |
| RP9 | 1558 | | GSLDESFYDWFERQLGKK | 6 | −0.45 | 42 |
| S375 | 1994 | C-N | (RP9-Lig)-14-(RP9-Lig) | 7 | −0.80 | 86 |
| S337 | 1960 and 1961 | C-C | (RP9-Lig)₂-23 | 0.2 | −0.36 | 14 |
| S391 | 2008 | | truncated-(-GSLDE)RP9(-KK) | 59 | −0.59 | 610 |
| S390 | 1794 | | truncated(-GSLD)RP9(-KK) | 27 | −0.49 | 127 |
| S414 | 2015 and 2016 | C-C | (truncated(-GSLD)RP9(-KK))₂-14 | 92 | −0.62 | 164 |
| S175 | 1560 | | GRVDWLQRNANFYDWFVAELG | 22 | −0.58 | 64 |
| S380 | 2001 and 2002 | C-C | (EE-short-S175-Lig)₂-9 | 10 | −0.55 | 23 |
| E8 (D120) | 2118 | | GGTVWPGYEWLRNA | 755 | −0.74 | |
| Insulin | | | | 59 | −0.37 | 63 |

| Monomer or Dimer | sIR-Fc b-RP9 FRET Hill | sIR-Fc FITC-RP9 FP IC50 (nM) | Hill | sIR FITC-RP9 FP IC50 (nM) | Hill | mIR FITC-RP9 FP IC50 (nM) | Hill | HIR ¹²⁵I-insulin RRA IC50 (nM) | FFC |
|---|---|---|---|---|---|---|---|---|---|
| H2C | −1.03 | 50 | −0.27 | 37 | −0.49 | 770 | −0.89 | 700 | + |
| S291 | −0.69 | | | 12 | −0.35 | 668 | −0.38 | 1200 | ++++ |
| RP9 | −0.69 | 10 | −0.41 | 0.03 | −0.29 | 49 | −0.53 | 44 | +/0 |
| S375 | −0.67 | | | 0.2 | −0.22 | 91 | −0.80 | 200 | ++++ |
| S337 | −0.57 | 1 | −0.37 | 0.2 | −0.28 | 111 | −0.70 | 11 | +++++ |
| S391 | −0.56 | | | 119 | −0.49 | 284 | −0.77 | 1500 | NN |
| S390 | −0.49 | | | 19 | −0.64 | 94 | −0.94 | 620 | + |
| S414 | −0.73 | | | 0.2 | −0.25 | 151 | −0.69 | NN | NN |
| S175 | −0.74 | 10 | −0.56 | 1 | −0.36 | 167 | −1.72 | 230 | +++ |
| S380 | −0.64 | | | 0.5 | −0.29 | 27 | −0.49 | 510 | ++ |
| E8 (D120) | | 207 | −0.49 | | | >100000 | | 2200 | − |
| Insulin | −0.46 | >100000 | −0.25 | 1250 | − | 172 | −0.78 | 0.04 | +++++ |

FRET = Time-Resolved Fluorescence Resonance Energy Transfer Assay; FP = Fluorescence Polarization Assay; RRA=Radio-Receptor Assay; FFC = Free Fat Cell Assay; N-N = N-terminal linkage; C-C = C-terminal linkage; All are site 1 (formula 1) monomers or site 1-site 1 (formula 1-formula 1) dimers;

Based on the functional studies outlined above, the following peptide were designed.

| SEQ ID NO: | Monom./ Linkers | Sequence |
|---|---|---|
| 2119 | F8-6aa-RP9 | HLCVLEELFWGASLFGYCSGGGSGGSGSLDESFYDWFERQL |
| 2120 | F8-12aa-RP9 | HLCVLEELFWGASLFGYCSGGGSGGSGGSGGSGSLDESFYDWFERQL |
| 2121 | D8-6aa-S175 | WLDQEWAWVQCEVYGRGCPSGGSGGSGRVDWLQRNANFYDWFVAELG |
| 2122 | D8-12aa-S175 | WLDQEWAWVQCEVYGRGCPSGGSGGSGGSGGSGRVDWLQRNANFYDWFVAELG |
| 2123 | F8-6aa-S175 | HLCVLEELFWGASLFGYCSGGGSGGSGRVDWLQRNANFYDWFVAELG |
| 2124 | F8-12aa-S175 | HLCVLEELFWGASLFGYCSGGGSGGSGGSGGSGRVDWLQRNANFYDWFVAELG |
| 2125 | D8-6aa-RP15 | HLCVLEELFWGASLFGYCSGGGSGGSSQAGSAFYAWFDQVLRTV |
| 2126 | D8-6aa-RP6 | HLCVLEELFWGASLFGYCSGGGSGGSTFYSCLASLLTGTPQPNRGPWERCR |
| 2127 | D8-6aa-RP17 | HLCVLEELFWGASLFGYCSGGGSGGSQSDAFYSGLWALIGLSDG |
| 2128 | D8-6aa-Grp 6 | HLCVLEELFWGASLFGYCSGGGSGGSDSD<u>WA</u>G<u>YEWF</u>EEQLD |

Linker sequences are underlined and in bold; Monomer sequences are shown below; All dimers are linked C-N.

| SEQ ID NO: | Monomer | Formula | Site | Sequence |
|---|---|---|---|---|
| 1576 | F8 | 4 | 2 | HLCVLEELFWGASLFGYCSG |
| 1558 | RP9 | 1 | 1 | GSLDESFYDWFERQL |
| 2129 | D8 | 6 | 2 | WLDQEWAWVQCEVYGRGCPS |
| 1560 | S175 | 1 | 1 | GRVDWLQRNANFYDWFVAELG |
| 2130 | RP15 | 1 | 1 | SQAGSAFYAWFDQVLRTV |
| 1635 | Rp6 | 2 | 1 | TFYSCLASLLTGTPQPNRGPWERCR |
| 2131 | RP17 | 1 | 1 | QSDAFYSGLWALIGLSDG |
| 1595 | Group 6 | 10 | 1 | DSDWAGYEWFEEQLD |

Example 8

Peptide Fusions To The Maltose Binding Protein

A. Cloning

The transfer of interesting peptide sequences from phage display to se binding protein (MBP) fusions is desirable for several reasons to obtain a more sensitive affinity estimate, the polyvalency of phage display peptides should be converted to a monovalent system. For this purpose, the peptide sequences are fused to MBP that generally exists as a monomer with no cysteine residues. Second, competition experiments can be carried out with the same or different peptides, one phage displayed and the other fused to MBP. Lastly, purified peptides can be obtained by cleavage of the fusion protein at a site engineered in the DNA sequence.

FIG. 28 shows a schematic drawing of the MBP-peptide construct. In the construct, the N-terminus of the peptide sequence is fused to the C-terminus of the MBP. Two peptide-flanking epitope tags are included, a shortened-FLAG® at the N-terminus and E-Tag at the C-terminus. The corresponding gene fusion was generated by ligating a vector fragment encoding the MBP in frame with a PCR product encoding the peptide of interest. The vector fragment was obtained by digesting the plasmid pMAL-c2 (New England Biolabs) with EcOR1 and HindIII and then treating the fragment with shrimp alkaline phosphatase (SAP; Amersham). The digested DNA fragment was resolved on a 1% agarose gel, excised, and purified by OIAEXII (QIAGEN). The 20-amino acid peptide sequences of interest were initially encoded in the phage display vector pCANTAB5E (Pharmacia). To obtain these sequences, primers were synthesized which anneal to sequences encoding the shortened FLAG® or E-Tag epitopes and also contain the required restriction enzyme sites EcOR1 and HindIII. PCR products were obtained from individual phage clones and digested with restriction enzymes to yield the insert fragment. The vector and insert were ligated overnight at 15° C. The ligation product was purified using QlAquick spin columns (QIAGEN) and electroporations were performed at 1500 v in an electroporation cuvette (0.1 mm gap; 0.5 ml volume) containing 10 ng of DNA and 40 µl of E. coli strain ER2508 (RR1 lon:min/Tn10(Tet$^r$) (malB) (argF-lac) U169 Pro$^+$zjc::Tn5(Kan$^r$) fhuA2) electrocompetent cells (New England Biolabs). Immediately after the pulse, 1 ml of pre-warmed (40° C.) 2xYT medium containing 2% glucose (2xYT-G) was added and the transformants were grown at 37° C. for 1 h. Cell transformants were plated onto 2xYT-AG plates and grown overnight at 37° C. Sequencing confirmed the clones contained the correct constructs.

B. Small-Scale Expression of Soluble MBP-Peptide Fusion Proteins

E. coli ER2508 (New England Biolabs) carrying the plasmids encoding MBP-peptide fusion proteins were grown in 2xYT-AG at 37° C. overnight (250 rpm). The following day the cultures were used to inoculate media (2xYT containing-G) to achieve an $OD_{600}$ of 0.1. When the cultures reached an $OD_{600}$ of 0.6, expression was induced by the addition of IPTG to a final concentration of 0.3 mM and then cells were grown for 3 h. The cells were pelleted by centrifugation and samples from total cells were analyzed by SDS-PAGE electrophoresis. The production of the correct molecular weight fusion proteins was confirmed by Western blot analysis using the monoclonal antibody anti-E-Tag-HRP conjugate (Pharmacia).

C. Large-Scale Expression of Soluble MBP-Peptide Fusion Proteins

E. coli ER2508 carrying plasmids encoding the MBP-peptide fusion proteins were grown in 2xYT-AG media for 8 h (250 rpm, 37° C.). The cultures were subcultured in 2xYT-AG to achieve an $OD_{600}$ of 0.1 and grown at 30° C.

overnight. This culture was used to inoculate a fermentor with medium of following composition (gAl): glucose (3.00); (NH$_4$)$_2$SO$_4$ 5.00; MgSO4*7H$_2$O (0.25); KH$_2$PO$_4$ (3.00); citric acid (3.00); peptone (10.00); and yeast extract (5.00); pH 6.8.

The culture was grown at 700 rpm, 37° C. until the glucose from the medium was consumed (OD$_{600}$=~6.0–7.0). Expression of the fusion protein was induced by the addition of 0.3 mM IPTG and the culture was grown for 2 h in fed-batch mode fermentation with feeding by 50% glucose at a constant rate of 2 gil/h. The cells were removed from the medium by centrifugation. Samples of the cell pellet were analyzed by SDS-PAGE followed by the Western blot analysis using the mouse monoclonal antibody anti-E-Tag-HRP conjugate (Pharmacia) to visualize the expressed product.

D. Purification

The cell pellets were disrupted mechanically by sonication or chemically by treatment with the mild detergent Triton X-100. After removal of cell debris by centrifugation, the soluble proteins were prepared for chromatographic purification by dilution or dialysis into the appropriate starting buffer. The MBP fusions were initially purified either by amylose affinity chromatography or by anion exchange chromatography. Final purification was performed using anti-E-Tag antibody affinity columns (Pharmacia). The affinity resin was equilibrated in TBS (0.025 M Tris-buffered saline, pH 7.4) and the bound protein was eluted with Elution buffer (100 mM glycine, pH 3.0). The purified proteins were analyzed for purity and integrity by SDS-PAGE and Western blot analysis according to standard protocols.

For MBP fusions, IR agonist activity was observed for the Site 1-Site 1: dimer peptides shown in Table 10, below. Additional binding data for the MBP fusions are shown in Table 11, also below.

TABLE 10

| Fus. | Monomer/Linker | Sequence | SEQ ID NO: | Form. | Act. | Site IR | Fus. Conc. | MW (kDa) | K$_d$(HIR) |
|---|---|---|---|---|---|---|---|---|---|
| 426 | D8 | MBP . . . NNNNLGIEGRISEFIEGRAQPAM AWLDQEWAWVQCEVYGRGCPSAAA(ETAG)AA | 2132 | 6 | N | 2 | 0.76 | 52.2 | 1.4 × 10$^{-6}$ |
| 429 | D8-6aa-D8 | MBP . . . NNNNLGIEGRISEFIEGRAQPAMAWL DQEWAWVQCEVYGRGCPSGGSGGSKWLDQEWAWVQC EVYGRGCPSAAA(ETAG)AA | 2133 | 6-6 | N-N | 2-2 | 3.2 | 55.3 | 1.3 × 10$^{-6}$ |
| 430 | H2C-4aa-RB6 | MBP . . . NNNNLGIEGRISEFIEGRDYKDDDDK FHENFYDWFVRQVSGSGSLDALDRLMRYFEERPS LETAG | 2134 | 1-6 | A- | 1-1 | 0.17 | 54.5 | 2.1 × 10$^{-6}$ |
| 431 | H2C-6aa-F8 | MBP . . . NNNNLGIEGRISEFIEGRDYKDDDK FHENFYDWFVRQVSGGSGGSHLCVLE ELFWGASLFGYCSGAAA(ETAG)AA | 2135 | 1-4 | A-N | 1-2 | 3.3 | 54.8 | 4.7 × 10$^{-8}$ |
| 432 | H2C-12aa-F8 | MBP-NNNNLGIEGRISEFIEGRDYKDDDKFHENFY DWFVRQVSGGSGGSGGSGGSHLCVLEELFWGASLFG YCSGAAA(ETAG)AA | 2136 | 1-4 | A-N | 1-2 | 2.9 | 55.5 | 3.5 × 10$^{-8}$ |
| 433 | H2C-9aa-F8 | MBP . . . NNNNLGIEGRISEFIEGRDYKDDDKF HENFYDWFVRQVSGGSGGSGGSHLCVLEELFWGAS LFGYCSGAAA(ETAG)AA | 2137 | 1-4 | A-N | 1-2 | 2.8 | 55.2 | 2.1 × 10$^{-8}$ |
| 434 | G3-12aa-G3 | MBP . . . NNNNLGIEGRISEFIEVRAQPAMARG GGTFYEWFESALRKHGAGGGSGGSGGSGGSRGGGTF YEWFESALRKHGAGAAA(ETAG)AA | 2138 | 1-1 | N-N | 1-1 | 0.01 | 56 | 3.2 × 10$^{-6}$ |
| 436 | H2C-9aa-H2C | MBP . . . NNNNLGIEGRISEFIEGRAQPAMAFH ENFYDWFVRQVSGGSGGSGGSFHENFYDWFVRQVSA AA(ETAG)AA | 2139 | 1-1 | A | 1-1 | 1.1 | 54.2 | 4.1 × 10$^{-7}$ |
| 437 | H2C | MBP . . . NNNNLGIEGRISEFIEGRAQPAMA FHENFYDWFVRQVSAAA(ETAG)AA | 2140 | 1 | N-N | 1 | 0.3 | 51.5 | 8.3 × 10$^{-6}$ |
| 427 | G3-6aa-G3 | MBP . . . NNNNLGIEGRISEFIEGRAQPAMAR GGGTFYEWFESTLRKHGAGGGSGGSRGGGTFYEWFE SALRKHGAGAAA(ETAG)AA | 2141 | 1-1 | N-N | 1-1 | 0.02 | 55.3 | 3.3 × 10$^{-6}$ |
| 435 | H2C-3aa-H2C-3aa-H2C | MBP . . . NNNNLGIEGRISEFIEGRAQPAMAFH ENFYDWFVRQVSGGSFHENFYDWFVRQVSGGSFH ENFYDWFVRQVSAAA(ETAG)AA | 2142 | 1-1-1 | A-A-A | 1-1-1 | 2.1 | 55.5 | 2.0 × 10$^{-6}$ |
| 439 | H2C-6aa-H2C | MBP . . . NNNNLGIEGRISEFIEGRAQPAMAFH ENFYDWFVRQVSGGSGGSFHENFYDWFVRQVS(ET AG)AA | 2143 | 1-1 | A-A | 1-1 | 1.4 | 53.9 | 5.5 × 10$^{-7}$ |
| 449 | H2C-12aa-H2C | MBP . . . NNNNLGIEGRISEFIEGRAQPAMAF HENFYDWFVRQVSGGSGGSGGSGGSAQPAMAFHENF YDWFVRQVSAAA(ETAG)AA | 2144 | 1-1 | | 1-1 | 1.5 | 51.8 | 6.2 × 10$^{-7}$ |
| 452 | G3 | MBP . . . NNNNLGIEGRISEFIEGRAQPAMARG GGTFYEWFESALRKHGAGAAA(ETAG)AA | 2145 | 1 | | 1 | 0.15 | 48.8 | 7.8 × 10$^{-7}$ |
| 463 | H2C-3aa-H2C | MBP . . . NNNNLGIEGRISEFIEGRAQPAMAFH ENFYDWFVRQVSGGSFHENFYDWFVRQVSAAA(ETA G)AA | 2146 | 1-1 | A-A | 1-1 | 1.8 | 50.1 | 9.6 × 10$^{-7}$ |
| 464 | LF-H2C | MBP . . . NNNNLGIEGRISEFIEGRDYKDDDDK FHENFYDWFVRQVSAA(ETAG)AA | 2147 | 1 | | 1 | 0.045 | 48.4 | 3.9 × 10$^{-8}$ |

TABLE 10-continued

| Fus. | Monomer/Linker | Sequence | SEQ ID NO: | Form. | Act. | Site IR | Fus. Conc. | MW (kDa) | $K_d$(HIR) |
|---|---|---|---|---|---|---|---|---|---|
| 446 | LF-F8 | MBP . . . NNNNLGIEGRISEFIEGRDYKDDDDK HLCVLEELFWGASLFGYCSGAAA(ETAG)AA | 2148 | 1 | | 2 | 1.9 | 49.1 | $7.7 \times 10^{-7}$ |
| 459 | SF-RB6 | MBP . . . NNNNLGIEGRISEFGSADYKDLDALD RLMRYFEERPSLAAA(ETAG)AA | 2149 | 3 | | 1 | 0.069 | 48.1 | $7.7 \times 10^{-8}$ |
| MBP* | lacZ | ** | | | na | | 5.1 | 50 | $>1 \times 10^{-5}$ |

*MBP (negative control for the fusions) is fused to a small fragment of beta-galactosidase (lacZ); **MBP-lacZ fusion protein was derived from the plasmid pMal-c2 as purchased form NEB. Fus. = fusion; Act. = activity; Conc. = concentration; N = Antagonist; A = Agonist; LF = Long FLAG ® epitope (DYKDDDDK; SEQ ID NO:1777); SF = Short FLAG epitope ® (DYKD; SEQ ID NO:1545); na = not applicable; Form. = formula; All dimers are linked C-N; Linker sequences are underlined.

TABLE 11

| Fusion | Monomer/Linker | Sequence | SEQ ID NO: | Form. | Site IR | High conc. tested ($\mu$M) | Kd (HIR) $\mu$M |
|---|---|---|---|---|---|---|---|
| 431- | H2C-6aa-F8 | MBP . . . NNNNLGIEGRISEFIEGRDYKDDDKF HENFYDWFVRQVSGGSGGSHLCVLEELFWGASLFG YCSGAAA(ETAG)AA | 2150 | 1-6 | 1-2 | 0.2 | 0.033 |
| 431+ | H2C-6aa-F8 | DYKDDDKFHENFYDWFVRQVSGGSGGSHLCVLEELFW GASLFGYCSGAAA(ETAG)AA | 2151 | 1-6 | 1-2 | 0.2 | 0.0074 |
| 432- | H2C-12aa-F8 | MBP . . . NNNNLGIEGRISEFIEGRDYKDDDKF HENFYDWFVRQVSGGSGGSGGSGGSHLCVLEELFWGA SLFGYCSGAAA(ETAG)AA | 2152 | 1-6 | 1-2 | 0.2 | 0.02 |
| 432+ | H2C-12aa-F8 | DYKDDDKFHENFYDWFVRQVSGGSGGSGGSGGSHLC VLEELFWGASLFGYCSGAAA(ETAG)AA | 2153 | 1-6 | 1-2 | 0.2 | 0.0038 |
| 433- | H2C-9aa-F8 | MBP . . . NNNNLGIEGRISEFIEGRDYKDDDKF HENFYDWFVRQVSGGSGGSGGSHLCVLEELFWGASL FGYCSGAAA(ETAG)AA | 2154 | 1-6 | 1-2 | 0.2 | 0.03 |
| 433+ | H2C-9aa-F8 | DYKDDDKFHENFYDWFVRQVSGGSGGSGGSHLCV LEELFWGASLFGYCSGAAA(ETAG)AA | 2155 | 1-6 | 1-2 | 0.2 | 0.004 |

The concentrations of these fusions vary depending on the expression quality. There are 2 sets of each fusion: uncleaved (−) and cleaved with factor Xa (+). The fusion proteins are in Tris buffer (20 mM Tris, 200 mM NaCl, 1 mM EDTA, 50 mM maltose, pH 7.5) and the cleaved fusions (+) are in the same Tris buffer (500 $\mu$l) + 12 $\mu$g Factor Xa. (Source of Factor Xa: New England Biolabs). Conc. = concentration; Form. = formula: All dimers are linked C-N; Linker sequences are underlined.

E. BIAcor Analysis

For BIAcore analysis of fusion protein and synthetic peptide binding to insulin receptor, insulin (50 zg/ml in 10 mM sodium acetate buffer pH 5) was immobilized on the CM5 sensor chip (Flowcell-2) by amine coupling. Flowcell-1 was used for background binding to correct for any non-specific binding. Insulin receptor (450 nM) was injected into the flow cell and the binding of IR to insulin was measured in resonance units (RUs). Receptor bound to insulin gave a reading of 220 RU. The surface was regenerated with 25 mM NaOH. Pre-incubation of receptor with insulin in a tube at RT completely abrogated the response units to 16 RU. Thus, the system was validated for competition studies. Several maltose-binding fusion proteins, peptides, and rVabs were pre-incubated with insulin receptor before injecting over the insulin chip for competition studies. The decrease in binding/resonance units indicates that several MBP-fusion proteins can block the insulin-binding site. The results are shown in Tables 12 and 13. The amino acid sequences referred to in the tables are identified in FIGS. 8 and 9A–9B, except the 447 and 2A9 sequences, which are shown below.

TABLE 12

BIAcore Results - Fusion Proteins Compete for Binding to IR

| | Incubation Mixtures | Result (RUs) | Sequence Type |
|---|---|---|---|
| Controls | Insulin Receptor (IR) 450 nM | 220 | Positive Control |
| | Insulin (8.7 $\mu$M) | 16 | Negative Control |
| MBP Fus. Prots. | A7 (20A4)-MBP (4.1 $\mu$M) + IR | 43 | Formula 6 Motif |
| | D8-MBP (1.6 $\mu$M) + IR | 56 | Formula 6 Motif |
| | D10-MBP (3.4 $\mu$M) + IR | 81 | Formula 11 Motif |
| | 447-MBP (11.5 $\mu$M) + IR | 195 | hGH Pept. Fus. |
| | MBP (13 $\mu$M) + IR | 209 | Negative Control |

The A7 (20A4), D8, and D10 peptide sequence are shown in FIGS. 8 and 9A–9B. The 447 peptide sequence is: LCQRLGVGWPGWLSGWCA (SEQ ID NO:2156).

TABLE 13

BIAcore Results - Synthetic peptides compete for binding to IR

| Incubation Mix | % Binding | Result (RUs) | Sequence Type |
|---|---|---|---|
| IR | 100 | 128 | Positive control |
| IR + 20D1 | 41 | 51.8 | Formula 1 Motif |
| IR + D8 | 33 | 41.6 | Formula 6 Motif |
| IR + 20C11 | 38 | 49 | Formula 2 Motif (bkg high) |
| IR + H2 | 27 | 34.6 | IGF (phosphorylated band) |
| IR + 2A9 | 100 | 128 | IGF (bkg high) |

TABLE 13-continued

BIAcore Results - Synthetic peptides compete for binding to IR

| Incubation Mix | % Binding | Result (RUs) | Sequence Type |
|---|---|---|---|
| IR + 20A4 | 33 | 41.8 | Formula 6 Motif |
| IR + p53wt | 97 | 124.5 | P53 wild type |

The concentration of each peptide was about 40 μM and the concentration of IR was 450 nM. The 20D1, 20A4, and D8 peptide sequences are shown in FIGS. 8 and 9A–9B. The remaining peptide sequences are as follows:
447 = LCQRLGVGWPGWLSGWCA (SEQ ID NO:2156);
2A9 = LCQSWGVRIGWLTGLCP (SEQ ID NO:2157);
20C11 = DRAFYNGLRDLVGAVYGAWD (SEQ ID NO:1659);
H2 = VTFTSAVFHENFYDWFVRQVS (SEQ ID NO:1784).

Regarding preparation of a Site 1 agonist comprising two D117 ($H_2C$) peptides, a linker of only 3 amino acids (12 Å) provided a ligand of greater affinity for Site 1 of IR than a corresponding ligand prepared with a 9 amino acid (36 Å) linking region (FIG. 29).

F. Stimulation of Autophosphorylation of IR by MBP-Fusion Peptides

MBP fusion peptides were prepared as described above, and then assayed for autophosphorylation of a insulin receptor construct transfected into 32D cells (Wang et al., 1993; clone 969) (see Example, above). The results of these experiments shown in FIG. 30 indicate that the $H_2C$ monomer and $H_2C$—$H_2C$ homodimer peptides stimulate autophosphorylation of IR in vivo. $H_2C$ dimer peptides (Site i-Site 1) with a 6 amino acid linker ($H_2C$-6aa-$H_2C$) were most active in the autophosphorylation assay. Other active dimer peptides are also shown in FIG. 30, particularly $H_2C$-9aa-$H_2C$, $H_2C$-12aa-$H_2C$, $H_2C$-3aa-$H_2C$, and F8.

G. Insulin Receptor Binding Affinity and Fat Cell Potency of MBP-Fusion Peptides Results of assays to determine binding affinity for insulin receptor and fat cell potency of the MBP-fusion peptides are shown in Table 14, below.

TABLE 14

| Peptide | SEQ ID NO: | Formula | Site IR | Sequence | HIR Kd (mol/l) | FFC |
|---|---|---|---|---|---|---|
| RB426 | 2158 | F6 | 2 | MBP . . . NNNNLGIEGRISEFIEGRAQPAMAWLDQEWAWVQCEVYGRGCPSAAA(ETAG)AA | $1.4 * 10^{-6}$ | |
| RB429 | 2159 | F6-F6 | 2-2 | MBP . . . NNNNLGIEGRISEFIEGRAQPAMAWLDQEWAWVQCEVYGRGCPSGGSGGSKWLDQEWAWVQCEVYGRGCPSAAA(ETAG)AA | $1.3 * 10^{-6}$ | |
| RB505M | 2160 | F4 | 2 | MBP . . . NNNNLGIEGRISEFIEGRDYKDDDDKHLCVLEELFWGASLFGYCSGAAA(ETAG)AA | | |
| RB517M | 2161 | F4-F4 | 2-2 | MBP . . . NNNNLGIEGRISEFIEGRDYKDDDDKHLCVLEELFWGASLFGYCSGGGSGGSHLCVLEELFWGASLFGYCSGAAA(ETAG)AA | | |
| RB515 | 2162 | F4-F4 | 2-2 | MBP . . . NNNNLGIEGRISEFIEGRDYKDDDDKHLCVLEELFWGASLFGYCSGGGSGGSGGSGGSHLCVLEELFWGASLFGYCSGAAA(ETAG)AA | | |
| RB510 | 2163 | F4-F4-F4 | 2-2-2 | MBP . . . NNNNLGIEGRISEFIEGRDYKDDDDKHLCVLEELFWGASLFGYCSGGGSGGSHLCVLEELFWGASLFGYCSGGGSGGSHLCVLEELFWGASLFGYCSGAAA(ETAG)AA | | |
| RB437 | 2164 | F1 | 1 | MBP . . . NNNNLGIEGRISEFIEGRAQPAMAFHENFYDWFVRQVSAAA(ETAG)AA | $8.3 * 10^{-6}$ | |
| RB463 | 2165 | F1-F1 | 1-1 | MBP . . . NNNNLGIEGRISEFIEGRAQPAMAFHENFYDWFVRQVSGGSFHENFYDWFVRQVSAAA(ETAG)AA | $9.6 * 10^{-7}$ | |
| RB439 | 2166 | F1-F1 | 1-1 | MBP . . . NNNNLGIEGRISEFIEGRAQPAMAFHENFYDWFVRQVSGGSGGSFHENFYDWFVRQVS-ETAG | $55 * 10^{-7}$ | |
| RB436 | 2167 | F1-F1 | 1-1 | MBP . . . NNNNLGIEGRISEFIEGRAQPAMAFHENFYDWFVRQVSGGSGGSGGSFHENFYDWFVRQVSAAA(ETAG)AA | $4.1 * 10^{-7}$ | |
| RB449 | 2168 | F1-F1 | 1-1 | MBP . . . NNNNLGIEGRISEFIEGRAQPAMAFHENFYDWFVRQVSGGSGGSGGSGGSAQPAMAFHENFYDWFVRQVSAAA(ETAG)AA | $6.2 * 10^{-7}$ | |
| RB435 | 2169 | F1-F1-F1 | 1-1-1 | MBP . . . NNNNLGIEGRISEFIEGRAQPAMAFHENFYDWFVRQVSGGSFHENFYDWFVRQVSGGSFHENFYDWFVRQVSAAA(ETAG)AA | $2.0 * 10^{-6}$ | |
| RB502 | 2170 | F1 | 1 | MBP . . . NNNNLGIEGRISEFIEGRDYKDDDDKVRVDWLQRNANFYDWFVAELVAAA(ETAG)AA | | |
| RB508M | 2171 | F1-F1 | 1-1 | MBP . . . NNNNLGIEGRISEFIEGRDYKDDDDKVRVDWLQRNANFYDWFVAELGGGSGGSGRVDWLQRNANFYDWFVAELGAAA(ETAG)AA | | |
| RB509M | 2172 | F1-F1 | 1-1 | MBP . . . NNNNLGIEGRISEFIEGRDYKDDDDKVRVDWLQRNANFYDWFVAELGGGSGGSGGSGSGRVDWLQRNANFYDWFVAELGAAA(ETAG)AA | | |
| RB452 | 2173 | F1 | 1 | MBP . . . NNNNLGIEGRISEFIEGRAQPAMARGGGTFYEWFESALRKHGAGAAA(ETAG)AA | $7.8 * 10^{-7}$ | |
| RB427 | 2174 | F1-F1 | 1-1 | MBP . . . NNNNLGIEGRISEFIEGRAQPAMARGGGTFYEWFESTLRKHGAGGGSGGSRGGGTFYEWFESALRKHGAGAAA(ETAG)AA | $33 * 10^{-6}$ | |
| RB434 | 2175 | F1-F1 | 1-1 | MBP . . . NNNNLGIEGRISEFIEVRAQPAMARGGGTFYEWFESALRKHGAGGGSGGSGGSRGGGTFYEWFESALRKHGAGAAA(ETAG)AA | $3.2 * 10^{-6}$ | |
| RB513 | 2176 | F1 | 1 | MBP . . . NNNNLGIEGRISEFIEGRDYKDDDDKGSLDESFYDWFERQLGKKAAA(ETAG)AA | | |
| RB516 | 2177 | F1-F1 | 1-1 | MBP . . . NNNNLGIEGRISEFIEGRDYKDDDDKGSLDESFYDWFERQLGKKGGSGGSGSLDESFYDWFERQLGKKAAA(ETAG)AA | | |
| RB512 | 2178 | F1-F1 | 1-1 | MBP . . . NNNNLGIEGRISEFIEGRDYKDDDDKGSLDESFYDWFERQLGKKGGSGGSGGSGSLDESFYDWFERQLGKKAAA(ETAG)AA | | |
| RB464 | 2179 | F1 | 1 | MBP . . . NNNNLGIEGRISEFIEGRDYKDDDDKFHENFYDWFVRQVSAAA(ETAG)AA | $3.8 * 10^{-18}$ | |
| RB446 | 2180 | F4 | 2 | MBP . . . NNNNLGIEGRISEFIEGRDYKDDDDKHLCVLEELFWGASLFGYCSGAAA(ETAG)AA | $7.7 * 10^{-7}$ | |

TABLE 14-continued

| Peptide | SEQ ID NO: | Formula | Site IR | Sequence | HIR Kd (mol/l) | FFC |
|---|---|---|---|---|---|---|
| RB459 | 2181 | F3 | 1 | MBP . . . NNNNLGIEGRISEFGSADYKDLDALDRLMRYFEERPSLAAA(ETAG)AA | $7.7 * 10^{-8}$ | |
| RB430 | 2182 | F1-F3 | 1-1 | MBP . . . NNNNLGIEGRISEFIEGRDYKDDDDKFHENFYDWFVRQVSGGSGGSLDALDRLMRYFEERPSLETAG | $2.1 * 10^{-6}$ | |
| RB430 | 2183 | F1-F3 | 1-1 | cleaved DYKDDDKFHENFYDWFVRQVSGSGSLDALDRLMRYFEERPSLAAA(ETAG)AA | $\sim 4 * 10^{-9}$ | |
| RB431 | 2184 | F1-F4 | 1-2 | MBP . . . NNNNLGIEGRISEFIEGRDYKDDDKFHENFYDWFVRQVSGGSGGSHLCVLEELFWGASLFGYCSGAAA(ETAG)AA | $4.7 * 10^{-8}$ | |
| RB431 | 2185 | F1-F4 | 1-2 | cleaved DYKDDDKFHENFYDWFVRQVSGGSGGSHLCVLEELFWGASLFGYCSGAAA(ETAG)AA | $\sim 8 * 10^{-9}$ | |
| RB432 | 2186 | F1-F4 | 1-2 | MBP-NNNNLGIEGRISEFIEGRDYKDDDKFHENFYDWFVRQVSGGSGGSGGSGGSHLCVLEELFWGASLFGYCSGAAA(ETAG)AA | $3.5 * 10^{-8}$ | |
| RB432 | 2187 | F1-F4 | 1-2 | cleaved DYKDDDKFHENFYDWFVRQVSGGSGGSGGSGGSHLCVLEELFWGASLFGYCSGAAA(ETAG)AA | $\sim 6 * 10^{-9}$ | |
| RB433 | 2188 | F1-F4 | 1-2 | MBP . . . NNNNLGIEGRISEFIEGRDYKDDDKFHENFYDWFVRQVSGGSGGSGGSHLCVLEELFWGASLFGYCSGAAA(ETAG)AA | $2.1 * 10^{-8}$ | |
| RB508 | 2189 | F1-F1 | 1-1 | DYKDDDDKVRVDWLQRNANFYDWFVAELGGGSGGSGRVDWLQRNANFYDWFVAELGAAAGAPVPYPDPLEPRSA | $1.5 * 10^{-7}$ | ++ |
| RB509 | 2190 | F1-F1 | 1-1 | DYKDDDDKVRVDWLQRNANFYAWFVAELGGGSGGSGGSGGSGRVDWLQRNANFYDWFVAELGAAAGAPVPYPDPLEPRAA | $5.5 * 10^{-8}$ | ++ |
| RB505 | 2191 | F4 | 2 | DYKDDDDKHLCVLEELFWGASLFGYCSGAAA(ETAG)AA | $4.8 * 10^{-7}$ | − |
| RB517 | 2192 | F4-F4 | 2-2 | DYKDDDDKHLCVLEELFWGASLFGYCSGGGSGGSHLCVLEELFWGASLFGYCSGAAA(ETAG)AA | $6.0 * 10^{-6}$ | − |
| RB521 | 2193 | F1-F1 | 1-1 | MADYKDDDDKGSLDESFYDWFERQLGKKGGSGGSGSLDESFYDWFERQLGKAAA(ETAG)PG | $4.4 * 10^{-8}$ | +++++ |
| RB535 | 2194 | F1-F1 | 1-1 | MADYKDDDDKGSLDESFYDWFERQLGKKGGSGGSGGSGGSGSLDESFYDWFERQLGKKAAA(ETAG)PG | $\sim 1.0 * 10^{-7}$ | +++++ |
| RB540 | 2195 | F6 | 2 | MADYKDDDDKWLDQEWAWVQCEVYGRGCPSAAA(ETAG)PG | $-1.0 * 10^{-7}$ | |
| RB539 | 2196 | F6-F1 | 2-1 | MADYKDDDDKWLDQEWAWVQCEVYGRGCPSGGSGGSGSLDESFYDWFERQLGKKAAA(ETAG)PG | $7 * 10^{-10}$ | ++++ |
| RB537 | 2197 | F1-F6 | 1-2 | MADYKDDDDKGSLDESFYDWFERQLGKKGGSGGSWLDQEWAWVQCEWGRGCPSAAA(ETAG)PG | $5.9 * 10^{-11}$ | − |
| RB538 | 2198 | F1-F6 | 1-2 | MADYKDDDDKGSLDESFYDWFERQLGKKGGSGGSGGSGGSWLDQEWAWVQCEVYGRGCPSAAA(ETAG)PG | $1.7 * 10^{-11}$ | − |
| RB626 | 2199 | F6-F1 | 2-1 | MADYKDEIEAEWGRVRCLVYGRCVGGGSGGSGGSGGSGSLDESFYDWFERQLGKKAAA(ETAG)PG | $3.0 * 10^{-10}$ | +++ |
| RB625 | 2200 | F6-F1 | 2-1 | MADYKDDDDKWLDQEWAWVQCEVYGRGCPSQPPPPDITTHRADPQGSLDESFYDWFERQLGKKAAA(ETAG)PG | $3.8 * 10^{-10}$ | +++++ |
| RB622 | 2201 | F6-F1 | 2-1 | MADYKDDDDKWLDQEWAWVQCEVYGRGCPSTPKPPTPPPLSADGSLDESFYDWFERQLGKKAAA(ETAG)PG | $1.0 * 10^{-9}$ | ++++ |
| RB596 | 2202 | F1 | 1 | MQNDDGSLDESFYDWFERQLGHHHHHHPG | $9.4 * 10^{-8}$ | |
| RB569 | 2203 | F1 | 1 | MGSLDESFYDWFERQLGEEEGGDHHHHHHPG | $2.1 * 10^{-7}$ | |
| RB570 | 2204 | F1 | 1 | MQNDDGSLDESFYDWFERQLGEEEGGDHHHHHHPG | $2.5 * 10^{-8}$ | |

ETAG = GAPVPYPDPLEPR(SEQ ID NO: 2205); MBP . . . NNNNL = fusion junction to MBP at c-terminus of MBP; All dimers are linked C-N.

Example 9

In Vivo Assays for Insulin Agonists

To test the in vivo activity of dimer peptide S519, an intravenous blood glucose test was carried out on Wistar rats. Male Mol:Wistar rats, weighing about 300 g, were divided into two groups. A 10 pjl sample of blood was taken from the tail vein for determination of blood glucose concentration. The rats were anaesthetized with Hypnorm/Dorrnicum at t=−30 min and blood glucose was measured again at t=−20 min and at t=0 min. After the t=0 sample was taken, the rats were injected into the tail vein with vehicle or test substance in an isotonic aqueous buffer at a concentration corresponding to a 1 ml/kg volume of injection. Blood glucose was measured at times 10, 20, 30, 40, 60, 80, 120, and 180 min. The Hypnorm/Dormicum administration was repeated at 20 minute intervals. Results shown in FIG. 33 demonstrate that the S519 (at 20 nmoltkg) peptide lowered blood glucose levels similar to levels observed for human insulin (at 2.5 nmollkg) (n=8). The S519 peptide and human insulin showed comparable in vivo effects, both in magnitude and onset of response (FIG. 33).

Example 10

IGF-1 Surrogates

Three major groups of peptide IGF-1 surrogates were obtained from IGF-1R panning experiments: Site 1 A6 (FyxWF) (SEQ ID NO: 1596); Site 1 B6 (FyxxLxxL) (SEQ ID NO: 1732), and Site 2 (C—C looped). See Beasley et al. International Application PCT/US00/08528, filed Mar. 29, 2000, and Beasley et al, U.S. application Ser. No. 09/538,038, filed Mar. 29, 2000. Active surrogates included 20E2 and RP6 (B6-like; Formula 2), S175 (A6-like; Formula 1), G33 (A6-like; Formula 1), RP9 (A6-like; Formula 1), D815 (Site 2), and D8B12 (Site 2) peptides. The IGF-1 surrogates were analyzed by various assays, described as follows.

A. Phage Competition

Phage competition studies were performed with Site 1 (RP9) and Site 2 (D815) monomer peptides. Plates were coated with IGF-1R (100 ng/well in carbonate buffer, pH 9.6) overnight at 40° C. Wells were blocked with 4% non-fat milk in PBS for 60 min at room temperature. One hundred microliters of rescued phage were added to each well. Peptides in varying concentrations were added and the mixtures were incubated for 2 hr at room temperature. Plates were washed three times with PBS and 100 µl of anti-M13 antibody conjugated to horseradish peroxidase was added to each well. The labeled antibody was incubated at room temperature for 60 min. After washing, 100 µl of ABTS was added per well and the plates read in a microtiter reader at 450 nM.

Phage included RP9 (A6-like; Formula 1); RP6 (B6-like; Formula 2); D8B12 (Site 2); and D815 (Site 2). Peptides included RP9 and D815.

| Peptide | Formula | Site IGF-1R | Sequence | SEQ ID NO: |
|---|---|---|---|---|
| D8B12 | 6 | 2 | WLEQERAWIWCEIQGSGCRA | 1884 |
| D815 | 6 | 2 | WLDQERAWLWCEISGRGCLS | 2206 |
| RP6 | 2 | 1 | TFYSCLASLLTGTPQPNRGPWERCR | 1635 |
| RP9 | 1 | 1 | GSLDESFYDWFERQLG | 1559 |

Results shown in FIGS. 34A–34E demonstrate that that RP9 and D815 peptides competed both Site 1 and Site 2 phage. These results illustrate the allosteric nature of the interaction with IGF-1R.

Phage competition studies were also performed with Site 2-Site 1 dimer peptides containing 6- or 12-amino acid linkers. Plates were coated with IGF-1R (100 ng/well in carbonate buffer, pH 9.6) overnight at 4° C. Wells were blocked with 4% non-fat milk in PBS for 60 min at room temperature. One hundred microliters of rescued phage were added to each well. Peptides in varying concentrations were added and the mixture incubated for 2 hr at room temperature. Plates were washed three times with PBS and 100 Eli of anti-M13 antibody conjugated to horseradish peroxidase was added to each well. The labeled antibody was incubated for 60 min at room temperature. After washing, 100 ill of ABTS was added per well and the plates read in a microtiter reader at 450 nM. Phage included RP9, RP6, D8B12, and D815. Peptides included D815-6L-RP9 and D815-12L-RP9. Linker sequences are underlined and shown below.

| Peptide | Formula | Site IGF-1R | Sequence | SEQ ID NO: |
|---|---|---|---|---|
| D815-6L-RP9 | 6-1 | 2-1 | LDQERAWLWCEISGRGCLS<u>GGSGGS</u>GSLDESFYDWFERQLGKK | 2207 |
| D815-12L-RP9 | 6-1 | 2-1 | WLDQERAWLWCEISGRGCLS<u>GGSGGSGGSGGS</u>GSLDESFYDWFERQLGKK | 2208 |

D8B12, D815, RP6, and RP9 amino acid sequences are shown in the previous section. Results shown in FIGS. 35A–35E demonstrate that dimers competed both Site 1 and Site 2 phage. This indicates that both dimer units were active at IGF-1R.

B. IGF-I Proliferation Assays

FDCP-2 cells expressing the IL-3 and human IGF-1R receptors were grown in RPMlk-1640 medium supplemented with 15% fetal bovine serum (FBS) and 5% WEHI conditioned medium (containing IL-3) in accordance with routine methods. Prior to an experiment, the cells were pelleted and washed two times in PBS. Following this, cells were resuspended in RPMI-1640 medium with 2% FBS and added to a 96-well plate at a concentration of $2 \times 10^4$ cells/well in 75 µl. This was designated as the cell plate.

Peptides were suspended in PPMI-15% FBS (test medium). For the agonist assay, medium was added to rows 2–12 of a 96 well plate. The peptide was added to row 1 in 200 µl of test medium at a final concentration of 60 µM. The peptide was serially diluted (1:1) across rows 2–11. No peptide was added to row 12 (control; cells without IGF-1). For the antagonist assay, test medium containing 10 ng/ml IGF-1 ($ED_{50}$ test medium) was added to all wells of a 96 well plate. To row 1 was added 100 µl of peptide in $ED_{50}$ test medium at a concentration of 120 µM. The peptide was serially diluted (1:1) across rows 2–11. No peptide was added to row 12 (control; cells with IGF-1).

For both agonist and antagonist assays, 75 µl from the working plates was transferred to the appropriate rows in comparable cell plates. The starting peptide concentration for both agonist and antagonist assays was 30 µM. Each peptide was done in duplicate. Plates were incubated at 37° C. for 45–48 hr. Ten microliters of WST-1 (Cell Proliferation Reagent, Roche cat # 1 644 807) were added to each well and the plates were read in an ELISA reader (440/700 dual wavelength) each hour for 4 hr. Graphs were prepared from the raw data using Sigma Plot. Peptides included:

| Peptide | Formula | Site IGF-1R | Sequence | SEQ ID NO: |
|---|---|---|---|---|
| 20E2 | 2 | 1 | DYKDFYDAIDQLVRGSARAGGTRD | 2209 |
| D815 | 6 | 2 | WLDQERAWLWCEISGRGCLS | 2206 |
| G33 | 1 | 1 | GIISQSCPESFYDWFAGQVSDPWWCW | 1600 |
| RP6 | 2 | 1 | TFYSCLASLLTGTPQPNRGPWERCR | 1635 |
| RP9 | 1 | 1 | GSLDESFYDWFERQLG | 1559 |
| S175 | 1 | 1 | GRVDWLQRNANFYDWFVAELG | 1560 |

Results of the IGF-1 proliferation assays are shown in FIGS. 36–42. FIG. 36 demonstrates that that peptides G33 (Site 1; $ED_{50}$~10 µM) and D815 (Site 2; $ED_{50}$~2 µM) showed agonist activity at IGF-1R, whereas peptides RP9 and RP6 showed no agonist activity. FIG. 37 demonstrates that that peptides RP6 (Site 1; $ED_{50}$~1 µM) and RP9 (Site 1; $ED_{50}$~7 ~M) showed antagonist activity at IGF-LR, whereas peptides G33 and D815 showed no antagonist activity. FIG. 38 demonstrates that peptides S175 and 20E2 exhibited weak agonist activity at IGF-R ($ED_{50}$>10 µM). FIG. 39 shows that D815-RP9 dimers with 6- or 12-amino acid linkers acted as agonists at IGF-1R. FIG. 40 shows that dimer peptide D815-6-G33 was inactive as an agonist at IGF-1R. FIG. 41 shows that monomer peptide RP6 acted as an antagonist at IGF-LR. The IGF-1 standard curve determined for FDCP-2 cells is shown in FIG. 42.

The IGF-1R data for the Site 1 and Site 2 peptides is summarized in Table 15, below.

TABLE 15

| Mon/Dimer | Form. | Site IGF-1R | Link. | Sequence | SEQ ID NO: | nM Ki app Kd | nM ED$_{50}$ Growth | Max Action | nM IC$_{50}$ Antag. | Ki/ED50 | Class |
|---|---|---|---|---|---|---|---|---|---|---|---|
| IGF-1 | | | NA | | | 0.69 | 0.30 | 100 | 2 | 2.3 | A |
| rG33 | 1 | 1 | NA | GIISQSCPESFYDWFAGQVSDPWWCW | 1600 | 1450 | 500 | >50 | — | 2.9 | A |
| rD815 | 6 | 2 | NA | WLDQERAWLWCEISGRGCLS | 2206 | 4080 | 500 | >50% | — | 8.2 | A |
| RP9 | 1 | 1 | NA | GSLDESFYDWFERQLG | 1559 | 417 | — | <10% | 900 | 0.5 | N |
| D815-G33 | 6-1 | 2-1 | 6 aa | WLDQERAWLWCEISGRGCLS<u>GGSGGS</u>GIISQSCPESFYDWFAGCVSDPWWCW | 2210 | 624 | — | <10% | nd | | nd |
| D815-RP9 | 6-1 | 2-1 | 6 aa | WLDQERAWLWCEISGRGCLS<u>GGSGGS</u>GSLDESFYDWFERQLGKK | 2211 | 36 | 50 | >50% | >500 | 0.8 | A |
| D815-RP9 | 6-1 | 2-1 | 12 aa | WLDQERAWLWCEISGRGCLS<u>GGSGGSGGSGGS</u>GSLDESFYDWFERQLGKK | 2212 | 3 | 10,000 | 100 | — | 0.0003 | A |

A = agonists; N = antagonist; nd = not determined; NA = not applicable; Form. = formula; Mon. = monomer; Antag. = antagonism; Link. = linker; Linker sequences are underlined.

Example 11: Panning Peptide Libraries

A. Panning IGF-1 Surrogate Secondary Libraries

Soluble IGF-1R ("sIGF-1R") was obtained from R&D Systems. The soluble protein (>95% pure) included the heterotetrameric (alpha 2-beta 2) extracellular domain of IGF-LR isolated from a mouse myeloma cell line sIGF-1R (500 ng\well) was added to an appropriate number of wells in a 96-well microtiter plate (MaxiSorp plates, NUNG) and incubated overnight at 4° C. Wells were then blocked with MPBS (PBS buffer pH 7.5 containing 2% Carnation® non-fat dry milk) at room temperature (RT) for 1 h. Eight wells were used for each round of panning for the G33 and RP6 secondary libraries. The phage were incubated with MPBS for 30 min at RT, then 100 pI was added to each well.

For the first round, the input phage titer was 4×1013 cfu/ml. For rounds 2 and 3, the input phage titer was approximately 1011 cfulml. Phage were allowed to bind for 2 to 3 h at RT. The wells were then quickly washed 13 times with 200 µl/well of MPBS. Bound phage were eluted by incubation with 100 µl/well of 20 mM glycine-HCl, pH 2.2 for 30 s. The resulting solution was then neutralized with Tris-HCl, pH 8.0. Log phase TG1 cells were infected with the eluted phage, then plated onto two 24 cm×24 cm plates containing 2xYT-AG. The plates were incubated at 30° C. overnight. The next morning, cells were removed by scraping and stored in 10% glycerol at −80° C. For subsequent rounds of affinity enrichment, cells from these frozen stocks were grown and phage were prepared as described above. A minimum of 72 clones was picked at random from the second, third, and fourth rounds of panning and screened for binding activity. DNA sequencing of the clones determined the amino acid sequences summarized in FIGS. 43A–43B.

B. Panning Peptide Dimer Libraries

Microtiter plates were coated and blocked by standard methods, as follows. Plates were coated with sIGF-IR (see Example, above) or soluble IR (Bass construct; Bass et al., 1996, J. Biol. Chem. 271:19367–19375) in 0.2 M NaHCO$_3$, pH 9.4. One hundred microliters of solution containing either 50 ng IR or IGF-1R (rounds 1 and 2), 25 ng IR or IGF-1R (round 3), or 12.5 ng IR or IGF-LR (round 4) was added to an appropriate number of wells in a 96-well microtiter plate (MaxiSorp plates, Nalge NUNC) and incubated overnight at 4° C. Wells were then blocked with a solution of 2% non-fat milk in PBS (MPBS) at RT for at least 1 h.

Eight wells coated with IR or IGF-1R were used for each round of panning. One hundred microliters of phage were added to each well. For the first round, the input phage titer was 3×10$^{13}$ cfu/ml. For subsequent rounds, the input phage titer was approximately 1012 cfulml. Phage were incubated for 2–3 h at RT. The wells were then quickly washed 13 times with 300 µl/well of PBS. Bound phage were eluted by incubation with 150 µl/well of 50 mM glycine-HCl, pH 2.0 for 15 min. The resulting solution was pooled and then neutralized with Tris-HCl, pH 8.0. Log phase TGI cells were infected with the eluted phage, in 2xYT medium for 1 hr at 37° C. prior to the addition of helper phage, ampicillin, and glucose (2% final concentration).

After incubation for 1 hr at 37° C., the cells were spun down and resuspended in 2xYT-AK medium. The cells were then returned to the shaker and incubated overnight at 37° C. Phage amplified overnight were then precipitated and subjected to the next round of panning. A total of 96 clones were picked at random from rounds 3 and 4 and screened for binding activity. Several clones from each pan were further tested for binding to IR or IGF-1R in phage ELISA by competition with soluble peptides as described in Beasley et al. International Application PCT/US00/08528, filed Mar. 29, 2000, and Beasley et al., U.S. application Ser. No. 09/538,038, filed Mar. 29, 2000. Competition was performed by addition of 5 µl of RP9 peptide, recombinant D8 peptide, or both per well, followed by addition of 100 µl of phage per well. Representative peptides are shown in FIGS. 44A–44B and in Table 16, below.

TABLE 16

| Pep. | SEQ ID NO: | Form. | Site IR | Sequence | Description |
|---|---|---|---|---|---|
| RP27 | 2213 | 6-1 | 2-1 | GLDQEQAWVECEVYGRGCPYGSLDESFYDWFERQLG | No linker |
| RP28 | 2214 | 6-1 | 2-1 | RLEEEWAWVQCEVYGRGCPS<u>GGSGGS</u>GSLDESFYDWFERQLG | EEE Stretch in D8 |
| RP29 | 2215 | 6-1 | 2-1 | SLDREWACVKCEVYGRGCPC<u>GGSGGS</u>GSLDESFYDWFERQLG | Repeat isolate |
| RP30 | 2216 | 6-1 | 2-1 | SLEEEWAQVECEVYGRGCPS<u>GGSGGS</u>GSLDESFYDWFERQLG | D8 by Design |

TABLE 16-continued

| Pep. | SEQ ID NO: | Form. | Site IR | Sequence | Description |
|---|---|---|---|---|---|
| RP31 | 2217 | 6-1 | 2-1 | SLEEEWAQVECEVYGRGCPSGGSGGSGLLDESFYHWFDRQLR | D8 & RP9 by design |
| RP32 | 2218 | 6-1 | 2-1 | SIEEEWAQIKCDVWGRGCPPGGSGGSGLLDESFYHWFDRQLR | D8 & RP9 by design |
| RP33 | 2219 | 6-1 | 2-1 | QLDLEWAWVQCEVYGRGCGGSGSLDESFYDWFERQLG | 3 amino acid linker |
| RP34 | 2220 | 6-1 | 2-1 | QLDEEWAGVQCEVYGRGCSLDESFYDWFERQLG | No linker |
| RP35 | 2221 | 6-1 | 2-1 | RLEEEWRWVQCEVYGRGCAAGGSGGSGSLDESFYDWFERQLG | EEE Stretch in D8 |
| RP36 | 2222 | 6-10 | 2-1 | SLDQEWAWVQCEVYGRGCPSGGSGGSDSDWAGYEWFEEQLD | D8 (W1->S)-Group 6 by design |

Pep. = peptide; Form. = formula; Linker sequences are shown in bold and underlined; All dimers are linked C-N C. Determination of Amino Acid Preferences For both monomer and dimer peptides, amino acid preferences for each peptide were determined as follows. The expected frequency of each of the 20 amino acids at that position was calculated based on codon usage and % doping for that library. This was then compared to the actual frequency of occurrence of each amino acid at every position after four rounds of biopanning. Any amino acid that occurred at a frequency>2-fold was considered preferred. Most preferred amino acid(s) were those that have the greatest fold enrichment after panning. Preferred amino acid sequences for RP9, D8, and Formula 10 (Group 6) peptides are shown below.

TABLE 17

| Peptide | Sequence | SEQ ID NO: |
|---|---|---|
| RP9 | GSLDESFYDWFERQLG | 1559 |
| Regular | GLADEDFYEWFERQLR<br>L | 2223 |
| w/ Peptide | GQLDEDFYEWFDRQLS<br>A | 2224 |
| w/ Insulin | GFMDESFYEWFERQLR<br>W A | 2225 |

Table 17 shows preferred amino acid sequences for RP9 peptides. Residues in bold indicate strong preference; underlined residues indicate positions where more than one amino acid preference is seen. The first column indicates the conditions used for the panning procedure. "RP9" indicates sequence of the parent RP9; "Regular" indicates regular pan as described in methods for panning of random libraries; "w/ peptide" indicates panning in the presence of 2 nM RP9 peptide; "w/insulin" indicates panning in the presence of 2 nM insulin.

TABLE 18

| Peptide | Sequence | SEQ ID NO: |
|---|---|---|
| D8 Parent: | WLDQEWAWVQCEVYGRGCPS | 2129 |
| Dimer Consensus | sLEEEWaQIECEVY/WGRGCps | 2226 |
| Monomer Consensus | sLEEEWaQIqCEIY/WGRGCry<br>W | 1548 |

Table 18 shows preferred amino acid sequences for D8 peptides. Upper case residues in bold indicate strong preference (>90% frequency); upper case letters, non-bold, indicate some preference (5–15% higher frequency than expected); lower case letters indicate less preference (2–5% higher frequency than expected); similar preferences seen in D8 in both monomer and dimer libraries. The underlined Y/W indicates that both residues are equally preferred at that position. In the original D8 sequence that position is occupied by Y.

TABLE 19

| Peptide | Sequence | Type | SEQ ID NO: |
|---|---|---|---|
| Group 6 | W(A/E)GYEW(F/L) | preferred core | 1549 |
| Group 6 | DSDWAGYEWFEEQLD | preferred sequence | 1595 |

Table 19 shows preferred amino acid sequences for Group 6 peptides. Underlined residues indicate preferred N-terminal and C-terminal extensions.

Example 12

Fluorescence-Based HIGF-1R Binding Assays

A. Heterogeneous Time Resolved Fluorometric Assays

The effect of recombinant peptide surrogate G33 (rG33) on the binding of biotinylated-recombinant human IGF-1 (b-rhIGF-1) to recombinant human IGF-1R (rhIGF-1R) was determined using heterogeneous time-resolved fluorometric assays (TRF; DELFIAO, PE Wallac, Inc.). The rhIGF-1!R protein included the extracellular domain of the receptor pre-propeptide, up to amino acid residue 932 (A. Ullrich et al., 1986, EMBO J. 5:2503–2512). Duplicate data points were collected at each concentration of competitor and the lines were designed to represent the best fit to a four-parameter non-linear regression analysis (y=min+(max−min)/(1+10^((logIC$_{50}$_x)*Hillslope))) of the data, which was used to determine ICM values.

The assay was performed using a 96-well clear microplate (NUNC MaxiSorp) with a final volume of 100 µl. Microtiter plates were coated with 0.1 µg rhIGF-1R in 100 µl of NaHCO$_3$, pH 8.5 buffer, and incubated overnight at room temperature (RT). The plates were washed 3-times with 0.05 M Tris-HCl (pH 8 at 25° C.), 0.138 M NaCl, 0.0027 M KCl (TBS). This was followed by addition of 200 µl blocking buffer (TBS containing 0.05% Bovine Serum Albumin (BSA, Cohn Fraction V)), and incubated for 1 hr at RT. The plates were washed 6-times with a 1×solution of Wallac's DELFIAO wash concentrate. Competitor was added in a volume of 50 µl and serially diluted across the microtiter plate in TBS containing 0.05% BSA. Non-specific binding (background) was determined in the presence of 60 µM hlGF-1.

Fifty microliters of b-rhIGF-1, 10 nM, diluted in TBS containing 0.05% BSA was added. The plates were incubated for 2 hr at RT. After incubation, plates were washed 6-times with a 1×solution of Wallac's DELFIAO wash concentrate. Then the plates were treated with 100 µL of Wallac's DELFIAO Assay Buffer containing a 1:1000 dilution of europium-labeled streptavidin and incubated for 2 hours at RT. This was followed by washing 6 times with a 1×solution of Wallac's DELFIAO wash concentrate. One hundred microliters of Wallac's DELFIA© enhancer was added, and the plates were shaken for 30 min at RT. After shaking, the fluorescence signal at 620 nm was read on a Victor² 1420 plate reader (PE Wallac. Inc.). Primary data were background corrected, normalized to buffer controls, and then expressed as % Specific Binding. The Z-factor was greater than 0.5 (Z'=1-(3σ$_+$+3σ$_-$)/|$\mu_{+-\mu}$; Zhang et al., 1999, J. Biomol. Screen. 4:67–73) and the signal-to-background (SIB) ratio was ~20. The results of these experiments are shown in FIG. 45. The IC$_{50}$ value calculated for rG33 is shown in Table 20, below.

The effect of recombinant peptide surrogates D815 (rD815), RP9, D815-6aa-G33, D8156aa-RP9, and D81512aa-RP9 on the binding of b-rhIGF-1 to rhIGF-1R was determined using the fluorometric assay described above. IGF-1 was used as a control. Duplicate data points were collected at each concentration of competitor and the lines represent the best fit to a four-parameter non-linear regression analysis, which was used to determine IC$_{50}$ values. Results for rD815 are show in FIG. 46; results for RP9 are shown in FIG. 47; results for D815-6-G33 are shown in FIG. 48; results for D815-6-RP9 are shown in FIG. 49; and results for D81512-RP9 are shown in FIG. 50; the results for IGF-1 are shown in FIG. 51. The IC$_{50}$ values for the rD815, RP9, D815-6aa-G33, D815-6aa-RP9, and D815-12aa-RP9 peptides, and IGF-1 are shown in Table 20, below. Linker sequences are underlined.

(LANCE™ labeled, PE Wallac, Inc.), 0.05 M Tris-HCl (pH 8 at 25° C.), 0.138 M NaCl, 0.0027 M KCl, and 0.1% BSA (Cohn Fraction V). Reactions were allowed to reach equilibrium for 6 hr at RT. Following this, various peptide surrogates or IGF-1 were added at a final concentration of 100 μM or 30 μM, respectively. The addition of peptides or IGF-1 initiated the measurement of dissociation (Time Zero, sec). The fluorescence signal at 665 nm was read on a Victor² 1420 plate reader (PE Wallac, Inc.) at 30 sec intervals.

Results of these experiments are shown in FIG. 52. The buffer controls did not vary over the time interval of study, which demonstrated that the equilibrium was not disturbed by the addition of diluent at Time zero. The addition of excess (>1000-fold 20E2 K$_d$ for IGF-1R) Site 1 peptides such as H$_2$C, 20E2, or RP6 did not differ depending on specific the peptide used, and the dissociation rates of b-20E2 were similar for these peptides. D8B12 (Site 2 peptide) and IGF-1 (binds both Site 1 and Site 2) did demonstrate significant differences in the rate of dissociation of b20E2. This would suggest that these agents act as noncompetitive or allosteric regulators of Site 1 binding.

The effect of various peptide surrogates or peptide dimers on the binding of biotinylated-20E2 (B-20E2) to recombinant human IGF-1R was determined using TR-FRET assays, described above. For these experiments, each data point

TABLE 20

| Competitor | Sequence | SEQ ID NO: | IC$_{50}$ (M) |
|---|---|---|---|
| rG33 | GIISQSCPESFYDWFAGQVSDPWWCW | 1600 | 1.45 × 10$^{-6}$ M |
| rD815 | WLDQERAWLWCEISGRGCLS | 2206 | 4.08 × 10$^{-6}$ M |
| RP9 | GSLDESFYDWFERQLG | 1559 | 4.17 × 10$^{-7}$ M |
| D815-6aa-G33 | WLDQERAWLWCEISGRGCLS<u>GGSGGS</u>GIISQSCPESFYDWFAGQVSDPWWCW | 2210 | 6.24 × 10$^{-7}$ M |
| D815-6aa-RP9 | WLDQERAWLWCEISGRGCLS<u>GGSGGS</u>GSLDESFYDWFERQLGKK | 2211 | 3.57 × 10$^{-8}$ M |
| D815-12aa-RP9 | WLDQERAWLWCEISGRGCLS<u>GGSGGSGGSGGSGS</u>GSLDESFYDWFERQLGKK | 2212 | 3.22 × 10$^{-9}$ M |
| IGF-1 | | | 6.85 × 10$^{-10}$ M |

The order of potency of all peptides or dimers compared to IGF-1 was determined as: IGF-1>D815-12aa-RP9>>D815-6aa-RP9>RP9≅D815-6aa-G33>rG33>rD815. These results suggest that the coupling of D815 with RP9 using an extended linker (12 versus 6 amino acids) produced a potent competitor that approximates the affinity of IGF-1 for its own receptor.

B. Time-Resolved Fluorescence Resonance Energy Transfer Assays

The effect of Site 1 peptide surrogates, Site 2 peptide surrogates, and rhIGF-1 on the dissociation of biotinylated-20E2 (b-20E2, Site 1) from recombinant human IGF-1R was determined using time-resolved fluorescence resonance energy transfer assays (TR-FRET). Best fit non-linear regression analysis of the data, was used to determine dissociation rate constants. Each data point represents a single observation.

The assay was performed using a 96-well white microplate (NUNC) with a final volume of 100 μl. Final incubation conditions were 16.5 nM b-20E2, 2.2 nM SA-APC (streptavidin-allophycocyanin), 2.2 nM Eu$^{3+}$-rhIGF-1R represents the average of two replicate wells. The lines represent the best fit to a four-parameter non-linear regression analysis (y=min+(max−min)/(1+10^((logIC$_{50}$-x)*Hillslope))) of the data, which was used to determine IC50 values.

The assays were performed using a 384-well white microplate (NUNC) with a final volume of 30 I. Final incubation conditions were 15 nM b-20E2, 2 nM SA-APC, 2 nM Eu$^{3+}$-rhIGF-1R (LANCE™ labeled, PE Wallac, Inc.), 0.05 M Tris-HCl (pH 8 at 25° C.), 0.138 M NaCl, 0.0027 M KCl, and 0.1%, BSA (Cohn Fraction V). After 16–24 hr of incubation at RT, the fluorescence signal at 665 nm and 620 nm was read on a Victor² 1420 plate reader (PE Wallac, Inc.). Primary data were background corrected, normalized to buffer controls, and then expressed as % Specific Binding. The Z'-factor was greater than 0.5 (Z'=1-(3a++3)/|$\mu_{+-\mu}$|; Zhang et al, 1999, J. Biomol. Screen. 4:67–73) and the signal-to-background (SIB) ratio was ~4. Results of these experiments are shown in FIG. 53. Table 21, below, shows the IC$_{50}$ values calculated for these experiments. Notably, the C1 peptide showed IGF-1R affinities of ~1 nM (FIG. 53) and ~10 nM (Table 21) in these assays.

TABLE 21

| Competitor | Sequence | SEQ ID NO: | Formula | Site IGF-1R | $IC_{50}$ (M) |
|---|---|---|---|---|---|
| C1 | CWARPCGDAANFYDWFVQQAS | 1550 | 1 | 1 | 8.80E-10 |
| IGF-1 | | | | | 2.93E-09 |
| RP9 | GSLDESFYDWFERQLG | 1559 | 1 | 1 | 3.93E-08 |
| 20E2 | DYKDFYDAIDQLVRGSARAGGTRD | 2209 | 2 | 1 | 1.04E-07 |
| E8 | GGTVWPGYEWLRNA | 2118 | 10 | 2 | 2.53E-07 |
| H2C | FHENFYDWFVQRVSKK | 2117 | 1 | 1 | 4.60E-07 |
| S173 | LDALDRLMRYFEERPSL | 1830 | 3 | 1 | 6.29E-06 |
| D8B12 | WLEQERAWIWCEIQGSGCRA | 1884 | 6 | 2 | 1.13E-05 |
| A6 | SAKNFYDWFVKK | 1551 | 1 | 1 | 3.10E-05 |

C. Fluorescence Polarization Assays

The effect of various peptide monomers and dimers on the binding of fluorescein-RP-9 (FITC-RP9) to soluble human insulin receptor-immunoglobulin heavy chain chimera (sIR-Fc; Bass et al., 1996, J. Biol. Chem. 271:19367–19375) was determined using fluorescence polarization assays (FP). For these experiments, each data point represents the average of two replicate wells. The lines represent the best fit to a four-parameter non-linear regression analysis of the data, which was used to determine $IC_{50}$ values.

The assays were performed in a 384-well black microplate (NUNC) with a final volume of 30 µl. Final incubation conditions were 1 nM FITC-RP9, 10 nM sIR, 0.05 M Tris-HCl (pH 8 at 25° C.), 0.138 M NaCl, 0.0027 M KCl, 0.05% BGG (bovine gamma globulin), 0.005% Tween-208. After 16–24 hr of incubation at RT, the fluorescence signal at 520 nm was read on an Analyst™ AD plate reader (LJL BioSystems, Inc.). Primary data were background corrected using 10 nM sIR without FITC-RP9 addition, normalized to buffer controls and then expressed as % Specific Binding. The Z'-factor was greater than 0.5 (Z' 1-(3v++3ff)Jt+–pf; Zhang et al, 1999, J. Biomol. Screen. 4:67–73) and the assay dynamic range was 125 mP. In parallel with these experiments, TR-FRET assays were performed using rhIGF-1R and b-20E2, as described above. Results of the FP and TR-FRET experiments are shown in Table 22, below.

These results demonstrated that S175, RP4, and RP15 showed high affinities for IR and showed high binding ratios for IGF-1R over IR. $H_2C$. 20E2, RP9, and C1 were slightly less potent than Si 75, RP4, and RP15 at IR, and these peptides had lower binding ratios for IGF-1R over IR. G33 and E8 were less potent than S175, RP4, and RP15 at IR, and showed comparable binding to IGF-IR and IR. RP16 had poor potency at IR and IGF-1R, but had higher affinity for IGF-1R than IR.

Incorporated herein by reference in its entirety is the Sequence Listing for the application, comprising SEQ ID NO:1 to SEQ ID NO:2227. The Sequence Listing is disclosed on three CD-ROMs, designated "CRF", "Copy 1", and "Copy 2". The Sequence Listing is a computer-readable ASCII file named "18784051US1.app.txt", created on Aug. 8, 2002, in IBM-PC machine format, on a MS-Windows®98 operating system. The 18784051 US1.app.txt file is 927,737 bytes in size.

As various changes can be made in the above compositions and methods without departing from the scope and spirit of the invention, it is intended that all subject matter contained in the above description, shown in the accompanying drawings, or defined in the appended claims be interpreted as illustrative, and not in a limiting sense.

The contents of all patents, patent applications, published articles, books, reference manuals, texts and abstracts cited herein are hereby incorporated by reference in their entirety to more fully describe the state of the art to which the present invention pertains.

TABLE 22

| Peptide | FP sIR-Fc | TR-FRET rhIGF-1R | Binding Ratio IGF-1R/IR | Formula | Site IGF-1R | SEQ ID NO: | Sequence |
|---|---|---|---|---|---|---|---|
| RP4 | 17 | 8100 | 476 | 2 | 1 | 1552 | PPWGARFYDAIEQLVFDNL |
| S175 | 10 | 1650 | 165 | 1 | 1 | 1560 | GRVDWLQRNANFYDWFVAELG |
| RP15 | 28 | 706 | 25 | 1 | 1 | 2130 | SQAGSAFYAWFOQVLRTV |
| H2C (D117) | 66 | 600 | 9 | 1 | 1 | 2117 | FHENFYDWFVQRVSKK |
| 20E2 (D118) | 51 | 100 | 1.9 | 2 | 1 | 2209 | DYKDFYDAIDQLVRGSARAGGTRD |
| RP9 | 24 | 33 | 1.4 | 1 | 1 | 1559 | GSLDESFYDWFERQLG |
| G33 | 139 | 178 | 1.3 | 1 | 1 | 1600 | GIISQSCPESFYDWFAGQVSDPWWCW |
| E8 (D120) | 206 | 175 | 0.85 | 10 | 2 | 2118 | GGTVWPGYEWLRNA |
| C1 (D112) | 52 | 10 | 0.19 | 1 | 1 | 1550 | CWARPCGDAANFYDWFVQQAS |
| RP16 | 6400 | 961 | 0.15 | | | 1553 | VMDARDDPFYHKLSELVT |

FP sIR-Fc column shows $IC_{50}$ (nM) values obtained (vs. FITC-RP9); TR-FRET rhIGF-1R column shows $IC_{50}$ (nM) values obtained (vs. b-20E2); for Binding Ratio: higher values indicated higher affinity for IR than IGF-1R.

SEQUENCE LISTING (2227 sequences)

SEQ ID NO: 1 - protein, 40 aa, Artificial Sequence
  Description of Artificial Sequence: Synthetic peptide
IRDMHYVWVQDRDRYINGVRQWYISDRYNPGSAFYRWFID

SEQ ID NO: 2 - protein, 40 aa, Artificial Sequence
  Description of Artificial Sequence: Synthetic peptide
RMGLQALAHYRKSAGPIFLSSGSVIKGSEGDPFYAWFRLQ

SEQ ID NO: 3 - protein, 40 aa, Artificial Sequence
  Description of Artificial Sequence: Synthetic peptide
MPVSLFRRVWDYRDGEHETLESHYVVPQAALDRLFYSWFS

SEQ ID NO: 4 - protein, 40 aa, Artificial Sequence
  Description of Artificial Sequence: Synthetic peptide
PLYGGGIHLYYPGTMGYVPGFPRQVKVLGDADKNFYDWFM

SEQ ID NO: 5 - protein, 39 aa, Artificial Sequence
  Description of Artificial Sequence: Synthetic peptide
YRGMLVLGRISDGAGKVASEPPARIGQKVFAVNFYDWFV

SEQ ID NO: 6 - protein, 39 aa, Artificial Sequence
  Description of Artificial Sequence: Synthetic peptide
SGCCRLLGLRWMFIVIVGWSGALVCQSAASAAGFYDWFV

SEQ ID NO: 7 - protein, 21 aa, Artificial Sequence
  Description of Artificial Sequence: Synthetic peptide
IGGQGQHQDGNFYDWFVEALA

SEQ ID NO: 8 - protein, 20 aa, Artificial Sequence
  Description of Artificial Sequence: Synthetic peptide
VFWNCRSQQLDFYEWFEQAA

SEQ ID NO: 9 - protein, 26 aa, Artificial Sequence
  Description of Artificial Sequence: Synthetic peptide
RVAGAISAPGLVSNKQDGLFYSWFRE

SEQ ID NO: 10 - protein, 20 aa, Artificial Sequence
  Description of Artificial Sequence: Synthetic peptide
VLQARHGCDSVSDCFYEWFA

SEQ ID NO: 11 - protein, 20 aa, Artificial Sequence
  Description of Artificial Sequence: Synthetic peptide
GAFYRWFHEALVGSERVPDV

SEQ ID NO: 12 - protein, 20 aa, Artificial Sequence
  Description of Artificial Sequence: Synthetic peptide
HEAFYDWFSALVDGGYELMG

SEQ ID NO: 13 - protein, 20 aa, Artificial Sequence
  Description of Artificial Sequence: Synthetic peptide
RIGGGWARSEGFYEWFVREL

SEQ ID NO: 14 - protein, 20 aa, Artificial Sequence
  Description of Artificial Sequence: Synthetic peptide
  MOD_RES (7): Unknown amino acid
  MOD_RES (11): Unknown amino acid
LPAGGAXGFAXRGFYEWFES

SEQ ID NO: 15 - protein, 20 aa, Artificial Sequence
  Description of Artificial Sequence: Synthetic peptide
GHSWALVRHVDRLFYEWFDL

SEQ ID NO: 16 - protein, 20 aa, Artificial Sequence
  Description of Artificial Sequence: Synthetic peptide
LGTSAGQGVGHRAFYQWFQS

SEQ ID NO: 17 - protein, 20 aa, Artificial Sequence
  Description of Artificial Sequence: Synthetic peptide
RGGGTFYEWFESALRKHGAG

SEQ ID NO: 18 - protein, 20 aa, Artificial Sequence
  Description of Artificial Sequence: Synthetic peptide
NSSGQQVVGLTFYSWFASQV

SEQ ID NO: 19 - protein, 20 aa, Artificial Sequence
  Description of Artificial Sequence: Synthetic peptide
FYGWFSRQLSLTPRDDWGLP

SEQ ID NO: 20 - protein, 20 aa, Artificial Sequence
  Description of Artificial Sequence: Synthetic peptide
RMFYEWFWSQMGAGPTEGSA

SEQ ID NO: 21 - protein, 21 aa, Artificial Sequence
  Description of Artificial Sequence: Synthetic peptide
IGGQGQHQDGNFYDWFVEALA

SEQ ID NO: 22 - protein, 20 aa, Artificial Sequence
  Description of Artificial Sequence: Synthetic peptide
RDKPTDQEEQNWSFYEWFRH

SEQ ID NO: 23 - protein, 20 aa, Artificial Sequence
  Description of Artificial Sequence: Synthetic peptide
WSALLSVMDTGFYAWFDDAV

SEQ ID NO: 24 - protein, 20 aa, Artificial Sequence
  Description of Artificial Sequence: Synthetic peptide
SRDQTNFTFNSAGFYGWFER

SEQ ID NO: 25 - protein, 17 aa, Artificial Sequence
  Description of Artificial Sequence: Synthetic peptide
GVGTLTMSSDAFYTWFV

SEQ ID NO: 26 - protein, 16 aa, Artificial Sequence
  Description of Artificial Sequence: Synthetic peptide
IGGSFVEFYGWFNDQV

SEQ ID NO: 27 - protein, 20 aa, Artificial Sequence
  Description of Artificial Sequence: Synthetic peptide
DIGSDGHGRRWDSFYRWFEM

SEQ ID NO: 28 - protein, 20 aa, Artificial Sequence
  Description of Artificial Sequence: Synthetic peptide
VLQARHGCDSVSDCFYEWFA

SEQ ID NO: 29 - protein, 20 aa, Artificial Sequence
  Description of Artificial Sequence: Synthetic peptide
DPERMQSDVGFYEWFRAAVG

SEQ ID NO: 30 - protein, 20 aa, Artificial Sequence
  Description of Artificial Sequence: Synthetic peptide
DPERMQSDVGFYEWFRAAVG

SEQ ID NO: 31 - protein, 20 aa, Artificial Sequence
  Description of Artificial Sequence: Synthetic peptide
DIGSDGHGRRWDSFYRWFEM

SEQ ID NO: 32 - protein, 20 aa, Artificial Sequence
  Description of Artificial Sequence: Synthetic peptide
PFYQWFLDQSVGGSRGGGLR

SEQ ID NO: 33 - protein, 20 aa, Artificial Sequence
  Description of Artificial Sequence: Synthetic peptide
AVAPLSVRGRDSGFYSWFSS

SEQ ID NO: 34 - protein, 21 aa, Artificial Sequence
  Description of Artificial Sequence: Synthetic peptide
  MOD_RES (1)..(10): Variable amino acid
  MOD_RES (18)..(21): Variable amino acid
XXXXXXXXXXNFYDWFVXXXX

SEQ ID NO: 35 - protein, 21 aa, Artificial Sequence
  Description of Artificial Sequence: Synthetic peptide
GRVDWLQRNANFYDWFVAELG

SEQ ID NO: 36 - protein, 21 aa, Artificial Sequence
  Description of Artificial Sequence: Synthetic peptide
RMYFSTGAPQNFYDWFVQEWD

SEQ ID NO: 37 - protein, 21 aa, Artificial Sequence
  Description of Artificial Sequence: Synthetic peptide
HHTQGLQVQRNFYDWFVNELR

SEQ ID NO: 38 - protein, 21 aa, Artificial Sequence
  Description of Artificial Sequence: Synthetic peptide
MHRMQHDGTSNFYDWFVLQWA

SEQ ID NO: 39 - protein, 21 aa, Artificial Sequence
  Description of Artificial Sequence: Synthetic peptide
AMHVVAQGGPNFYDWFVRELR

SEQ ID NO: 40 - protein, 21 aa, Artificial Sequence
  Description of Artificial Sequence: Synthetic peptide
AIQMNGNLAFNFYDWFVRELT

SEQ ID NO: 41 - protein, 21 aa, Artificial Sequence
  Description of Artificial Sequence: Synthetic peptide
TDRKSVQEPRNFYDWFVWAAR

SEQ ID NO: 42 - protein, 21 aa, Artificial Sequence
  Description of Artificial Sequence: Synthetic peptide
PHGHRGFAQSNFYDWFVTQEE

SEQ ID NO: 43 - protein, 21 aa, Artificial Sequence
  Description of Artificial Sequence: Synthetic peptide
RLASASVPGQNFYDWFVDQLL

SEQ ID NO: 44 - protein, 21 aa, Artificial Sequence
  Description of Artificial Sequence: Synthetic peptide
RQSEFSTLNSNFYDWFVRELE

SEQ ID NO: 45 - protein, 21 aa, Artificial Sequence
  Description of Artificial Sequence: Synthetic peptide
GQAQLSIRDVNFYDWFVQQLV

SEQ ID NO: 46 - protein, 21 aa, Artificial Sequence
  Description of Artificial Sequence: Synthetic peptide
MSEPAVGVNGNFYDWFVAQLF

SEQ ID NO: 47 - protein, 21 aa, Artificial Sequence
  Description of Artificial Sequence: Synthetic peptide
VGTGRARLDRNFYDWFVGQYS

SEQ ID NO: 48 - protein, 21 aa, Artificial Sequence
  Description of Artificial Sequence: Synthetic peptide
SREAVQKRNANFYDWFVQQLS

SEQ ID NO: 49 - protein, 21 aa, Artificial Sequence
  Description of Artificial Sequence: Synthetic peptide
LAQFAGSRNQNFYDWFVEQLG

SEQ ID NO: 50 - protein, 21 aa, Artificial Sequence
  Description of Artificial Sequence: Synthetic peptide
GQEYFDQMGLNFYDWFVRELD

SEQ ID NO: 51 - protein, 21 aa, Artificial Sequence
  Description of Artificial Sequence: Synthetic peptide
RQPSQPPHGSNFYDWFVEAIN

SEQ ID NO: 52 - protein, 21 aa, Artificial Sequence
  Description of Artificial Sequence: Synthetic peptide
LMQSLGSGSTNFYDWFVQQMV

SEQ ID NO: 53 - protein, 21 aa, Artificial Sequence
  Description of Artificial Sequence: Synthetic peptide
DQQRSACDGTNFYDWFVCQLS

SEQ ID NO: 54 - protein, 21 aa, Artificial Sequence
  Description of Artificial Sequence: Synthetic peptide
LDGTKACQRVNFYDWFVCQTE

SEQ ID NO: 55 - protein, 21 aa, Artificial Sequence
  Description of Artificial Sequence: Synthetic peptide
PEARRTVVHSNFYDWFVAQLS

SEQ ID NO: 56 - protein, 21 aa, Artificial Sequence
  Description of Artificial Sequence: Synthetic peptide
PWMLSVGIQDNFYDWFVGLDS

SEQ ID NO: 57 - protein, 21 aa, Artificial Sequence
  Description of Artificial Sequence: Synthetic peptide
ASHQRGGSSDNFYDWFVAQMR

SEQ ID NO: 58 - protein, 21 aa, Artificial Sequence
  Description of Artificial Sequence: Synthetic peptide
TLEREGEFSGNFYDWFVEQLH

SEQ ID NO: 59 - protein, 21 aa, Artificial Sequence
  Description of Artificial Sequence: Synthetic peptide
DRQSIGSVHGDFYDWFVSALG

SEQ ID NO: 60 - protein, 21 aa, Artificial Sequence
  Description of Artificial Sequence: Synthetic peptide
DWDKLGSLSENFYDWFVDQLA

SEQ ID NO: 61 - protein, 21 aa, Artificial Sequence
  Description of Artificial Sequence: Synthetic peptide
VRVVLNQSGRNFYDWFVIQLE

SEQ ID NO: 62 - protein, 21 aa, Artificial Sequence
  Description of Artificial Sequence: Synthetic peptide
MASWQSRTPDNFYDWFVRELS

SEQ ID NO: 63 - protein, 21 aa, Artificial Sequence
  Description of Artificial Sequence: Synthetic peptide
TTCHPRGEDCNFYDWFVLQLR

SEQ ID NO: 64 - protein, 21 aa, Artificial Sequence
  Description of Artificial Sequence: Synthetic peptide
VRGNDSVLRANFYDWFVDQLS

SEQ ID NO: 65 - protein, 21 aa, Artificial Sequence
  Description of Artificial Sequence: Synthetic peptide
TPRSQVRSDHNFYDWFVYQLA

SEQ ID NO: 66 - protein, 21 aa, Artificial Sequence
  Description of Artificial Sequence: Synthetic peptide
ESLTGSRPDRNFYDWFVQQTS

SEQ ID NO: 67 - protein, 21 aa, Artificial Sequence
  Description of Artificial Sequence: Synthetic peptide
PQSLTEVRTGNFYDWFVVQLH

SEQ ID NO: 68 - protein, 21 aa, Artificial Sequence
  Description of Artificial Sequence: Synthetic peptide
DVGMGRVKETNFYDWFVRQLI

SEQ ID NO: 69 - protein, 21 aa, Artificial Sequence
  Description of Artificial Sequence: Synthetic peptide
GADDIRSLNTNFYDWFVNQLS

SEQ ID NO: 70 - protein, 21 aa, Artificial Sequence
  Description of Artificial Sequence: Synthetic peptide
GVSIQAGYKTNFYDWFVEAVR

SEQ ID NO: 71 - protein, 21 aa, Artificial Sequence
  Description of Artificial Sequence: Synthetic peptide
VGEHRQMSVGNFYDWFVMQIA

SEQ ID NO: 72 - protein, 21 aa, Artificial Sequence
  Description of Artificial Sequence: Synthetic peptide
GSSLGRSGPGNFYDWFVDQLE

SEQ ID NO: 73 - protein, 21 aa, Artificial Sequence
  Description of Artificial Sequence: Synthetic peptide
HRQQDVVRQGNFYDWFVQALE

SEQ ID NO: 74 - protein, 21 aa, Artificial Sequence
  Description of Artificial Sequence: Synthetic peptide
QDTFLTAREGNFYDWFIRALE

SEQ ID NO: 75 - protein, 21 aa, Artificial Sequence
  Description of Artificial Sequence: Synthetic peptide
EAIMREEGQANFYDWFVRQLE

SEQ ID NO: 76 - protein, 21 aa, Artificial Sequence
  Description of Artificial Sequence: Synthetic peptide
VCDVSTGGGTNFYDWFVCQVG

SEQ ID NO: 77 - protein, 21 aa, Artificial Sequence
  Description of Artificial Sequence: Synthetic peptide
PQPRSASTPLNFYDWFVQATG

SEQ ID NO: 78 - protein, 21 aa, Artificial Sequence
  Description of Artificial Sequence: Synthetic peptide
GVSRGSGGDPNFYDWFVMQLR

SEQ ID NO: 79 - protein, 21 aa, Artificial Sequence
  Description of Artificial Sequence: Synthetic peptide
GPGRHDSSRGNFYDWFVEQLA

SEQ ID NO: 80 - protein, 21 aa, Artificial Sequence
  Description of Artificial Sequence: Synthetic peptide
ERFALEVQGSNFYDWFVRQVI

SEQ ID NO: 81 - protein, 20 aa, Artificial Sequence
  Description of Artificial Sequence: Synthetic peptide
NLKSSATVGGNFYDWFVEQL

SEQ ID NO: 82 - protein, 21 aa, Artificial Sequence
  Description of Artificial Sequence: Synthetic peptide
MEGPPAGGPLNFYDWFVAQVD

SEQ ID NO: 83 - protein, 21 aa, Artificial Sequence
  Description of Artificial Sequence: Synthetic peptide
RLDVAGHRGGNFYDWFVKQLH

SEQ ID NO: 84 - protein, 21 aa, Artificial Sequence
  Description of Artificial Sequence: Synthetic peptide
PWSDHEALNQNFYDWFVSQVL

SEQ ID NO: 85 - protein, 21 aa, Artificial Sequence
  Description of Artificial Sequence: Synthetic peptide
EDRLGNGESTNFYDWFVRQLA

SEQ ID NO: 86 - protein, 21 aa, Artificial Sequence
  Description of Artificial Sequence: Synthetic peptide
GKLVASTLDDNFYDWFVRQLS

SEQ ID NO: 87 - protein, 21 aa, Artificial Sequence
  Description of Artificial Sequence: Synthetic peptide
SGPVVQTQNGNFYDWFVHQLR

SEQ ID NO: 88 - protein, 21 aa, Artificial Sequence
  Description of Artificial Sequence: Synthetic peptide
VDRAGPAGSDNFYDWFVAQLD

SEQ ID NO: 89 - protein, 21 aa, Artificial Sequence
  Description of Artificial Sequence: Synthetic peptide
SLGRNDRPDENFYDWFVSQVQ

SEQ ID NO: 90 - protein, 21 aa, Artificial Sequence
  Description of Artificial Sequence: Synthetic peptide
RVMATANAPMNFYDWFVVQLQ

SEQ ID NO: 91 - protein, 21 aa, Artificial Sequence
  Description of Artificial Sequence: Synthetic peptide
NGVERAGTGDNFYDWFVAQLH

SEQ ID NO: 92 - protein, 21 aa, Artificial Sequence
  Description of Artificial Sequence: Synthetic peptide
PFAGKGDKTGNFYDWFVSLTG

SEQ ID NO: 93 - protein, 21 aa, Artificial Sequence
  Description of Artificial Sequence: Synthetic peptide
GMPQEYMDQVNFYDWFVAQVD

SEQ ID NO: 94 - protein, 21 aa, Artificial Sequence
  Description of Artificial Sequence: Synthetic peptide
MGTPAVGDGANFYDWFVRQLG

SEQ ID NO: 95 - protein, 21 aa, Artificial Sequence
  Description of Artificial Sequence: Synthetic peptide
SKCKAWYGANNFYDWFVWQVD

SEQ ID NO: 96 - protein, 21 aa, Artificial Sequence
  Description of Artificial Sequence: Synthetic peptide
EAASLGSQDRNFYDWFVRQVV

SEQ ID NO: 97 - protein, 21 aa, Artificial Sequence
  Description of Artificial Sequence: Synthetic peptide
VERSASSQDGNFYDWFVVQIR

SEQ ID NO: 98 - protein, 21 aa, Artificial Sequence
  Description of Artificial Sequence: Synthetic peptide
TSEVQRRSQDNFYDWFVAQVA

SEQ ID NO: 99 - protein, 21 aa, Artificial Sequence
  Description of Artificial Sequence: Synthetic peptide
ERSAAGFREGNFYDWFVAQVN

SEQ ID NO: 100 - protein, 21 aa, Artificial Sequence
  Description of Artificial Sequence: Synthetic peptide
RAERGSMRDSNFYDWFVQQLP

SEQ ID NO: 101 - protein, 21 aa, Artificial Sequence
  Description of Artificial Sequence: Synthetic peptide
LAMSVASRPANFYDWFVAQIV

SEQ ID NO: 102 - protein, 21 aa, Artificial Sequence
  Description of Artificial Sequence: Synthetic peptide
HNSSSPMRTGNFYDWFVQELR

SEQ ID NO: 103 - protein, 20 aa, Artificial Sequence
  Description of Artificial Sequence: Synthetic peptide
SALSGPVQPINFYDWFVTGM

SEQ ID NO: 104 - protein, 21 aa, Artificial Sequence
  Description of Artificial Sequence: Synthetic peptide
GAQAIREIHHNFYDWFVAQVT

SEQ ID NO: 105 - protein, 21 aa, Artificial Sequence
  Description of Artificial Sequence: Synthetic peptide
RGQRESDSGTNFYDWFVGAIR

SEQ ID NO: 106 - protein, 21 aa, Artificial Sequence
  Description of Artificial Sequence: Synthetic peptide
VQEGLSGMEGNFYDWFVDQLF

SEQ ID NO: 107 - protein, 21 aa, Artificial Sequence
  Description of Artificial Sequence: Synthetic peptide
RLDRSSTSGVNFYDWFVAQVG

SEQ ID NO: 108 - protein, 21 aa, Artificial Sequence
  Description of Artificial Sequence: Synthetic peptide
GSQHSGREPHNFYDWFVAQVG

SEQ ID NO: 109 - protein, 21 aa, Artificial Sequence
  Description of Artificial Sequence: Synthetic peptide
GRGDQRHETTNFYDWFVRELQ

SEQ ID NO: 110 - protein, 21 aa, Artificial Sequence
  Description of Artificial Sequence: Synthetic peptide
PRMVEKPSEDNFYDWFVTQLS

SEQ ID NO: 111 - protein, 21 aa, Artificial Sequence
  Description of Artificial Sequence: Synthetic peptide
RVGIQVDPHTNFYDWFVIQLT

SEQ ID NO: 112 - protein, 21 aa, Artificial Sequence
  Description of Artificial Sequence: Synthetic peptide
RSSGGLLSQGNFYDWFVSQLE

SEQ ID NO: 113 - protein, 21 aa, Artificial Sequence
  Description of Artificial Sequence: Synthetic peptide
SDARQAGLQENFYDWFVSQVR

SEQ ID NO: 114 - protein, 21 aa, Artificial Sequence
  Description of Artificial Sequence: Synthetic peptide
PPYRSSRLGENFYDWFVMQVR

SEQ ID NO: 115 - protein, 21 aa, Artificial Sequence
  Description of Artificial Sequence: Synthetic peptide
QEVTRTRDDKNFYDWFVSQIF

SEQ ID NO: 116 - protein, 21 aa, Artificial Sequence
  Description of Artificial Sequence: Synthetic peptide
SRAPYGSTAGNFYDWFVQAVS

SEQ ID NO: 117 - protein, 21 aa, Artificial Sequence
  Description of Artificial Sequence: Synthetic peptide
  MOD_RES (1): Unknown amino acid
XDGQSVSSKGNFYDWFVQQMT

SEQ ID NO: 118 - protein, 21 aa, Artificial Sequence
  Description of Artificial Sequence: Synthetic peptide
RLMGGIAEPQNFYDWFVREVA

SEQ ID NO: 119 - protein, 21 aa, Artificial Sequence
  Description of Artificial Sequence: Synthetic peptide
SAGHHMPRESNFYDWFVDQVV

SEQ ID NO: 120 - protein, 21 aa, Artificial Sequence
  Description of Artificial Sequence: Synthetic peptide
LGAAETWDGINFYDWFVKQVS

SEQ ID NO: 121 - protein, 21 aa, Artificial Sequence
  Description of Artificial Sequence: Synthetic peptide
VGHSGVPPYPNFYDWFVMQVS

SEQ ID NO: 122 - protein, 21 aa, Artificial Sequence
  Description of Artificial Sequence: Synthetic peptide
VTMLDKGAQDNFYDWFVREVA

SEQ ID NO: 123 - protein, 21 aa, Artificial Sequence
  Description of Artificial Sequence: Synthetic peptide
HHSPGNEHGYNFYDWFVLQVA

SEQ ID NO: 124 - protein, 21 aa, Artificial Sequence
  Description of Artificial Sequence: Synthetic peptide
GSIAQLIMRANFYDWFVEQTN

SEQ ID NO: 125 - protein, 21 aa, Artificial Sequence
  Description of Artificial Sequence: Synthetic peptide
LKGSSQPLSVNFYDWFVQQIK

SEQ ID NO: 126 - protein, 21 aa, Artificial Sequence
  Description of Artificial Sequence: Synthetic peptide
PASNKNSLAENFYDWFVQQTR

SEQ ID NO: 127 - protein, 21 aa, Artificial Sequence
  Description of Artificial Sequence: Synthetic peptide
HVEHMAVGDGNFYDWFVVQLR

SEQ ID NO: 128 - protein, 21 aa, Artificial Sequence
  Description of Artificial Sequence: Synthetic peptide
RGMTGMVGRGNFYDWFVGQLR

SEQ ID NO: 129 - protein, 21 aa, Artificial Sequence
  Description of Artificial Sequence: Synthetic peptide
GLRSEQGNRLNFYDWFVAQIA

SEQ ID NO: 130 - protein, 21 aa, Artificial Sequence
  Description of Artificial Sequence: Synthetic peptide
RVREKLPRPENFYDWFVNQIH

SEQ ID NO: 131 - protein, 21 aa, Artificial Sequence
  Description of Artificial Sequence: Synthetic peptide
SNPSRQDASVNFYDWFVREVA

SEQ ID NO: 132 - protein, 21 aa, Artificial Sequence
  Description of Artificial Sequence: Synthetic peptide
QSVDLSRPDSNFYDWFVEVLS

SEQ ID NO: 133 - protein, 21 aa, Artificial Sequence
  Description of Artificial Sequence: Synthetic peptide
IGGQGQHQDGNFYDWFVEALA

SEQ ID NO: 134 - protein, 21 aa, Artificial Sequence
  Description of Artificial Sequence: Synthetic peptide
VEVQRHIRKDNFYDWFVKQID

SEQ ID NO: 135 - protein, 21 aa, Artificial Sequence
  Description of Artificial Sequence: Synthetic peptide
CWARPCGDAANFYDWFVQQAS

SEQ ID NO: 136 - protein, 21 aa, Artificial Sequence
  Description of Artificial Sequence: Synthetic peptide
RHERGKEGPGNFYDWFVSQVV

SEQ ID NO: 137 - protein, 21 aa, Artificial Sequence
  Description of Artificial Sequence: Synthetic peptide
ERSPRPALASNFYDWFVQQVV

SEQ ID NO: 138 - protein, 21 aa, Artificial Sequence
  Description of Artificial Sequence: Synthetic peptide
IARMRETFQPNFYDWFVDQLA

SEQ ID NO: 139 - protein, 21 aa, Artificial Sequence
  Description of Artificial Sequence: Synthetic peptide
GRGQGLKRPDNFYDWFVAAAK

SEQ ID NO: 140 - protein, 21 aa, Artificial Sequence
  Description of Artificial Sequence: Synthetic peptide
YSIEVQDWNENFYDWFVSQLG

SEQ ID NO: 141 - protein, 21 aa, Artificial Sequence
  Description of Artificial Sequence: Synthetic peptide
TWMWEERKQDNFYDWFVGQLK

SEQ ID NO: 142 - protein, 21 aa, Artificial Sequence
  Description of Artificial Sequence: Synthetic peptide
VTFTSAVFHENFYDWFVRQVS

SEQ ID NO: 143 - protein, 21 aa, Artificial Sequence
  Description of Artificial Sequence: Synthetic peptide
LAINDLVTHKNFYDWFVDQLR

SEQ ID NO: 144 - protein, 21 aa, Artificial Sequence
  Description of Artificial Sequence: Synthetic peptide
GAVGLAEAGPNFYDWFVSQVQ

SEQ ID NO: 145 - protein, 21 aa, Artificial Sequence
  Description of Artificial Sequence: Synthetic peptide
RYRGERHDGRNFYDWFVEQVN

SEQ ID NO: 146 - protein, 21 aa, Artificial Sequence
  Description of Artificial Sequence: Synthetic peptide
QGAEGRLSEGNFYDWFVQAVS

SEQ ID NO: 147 - protein, 21 aa, Artificial Sequence
  Description of Artificial Sequence: Synthetic peptide
PRLHMGSDMGDFYDWFVVQIA

SEQ ID NO: 148 - protein, 21 aa, Artificial Sequence
  Description of Artificial Sequence: Synthetic peptide
IVAGARHSEVNFYDWFVIQVR

SEQ ID NO: 149 - protein, 21 aa, Artificial Sequence
  Description of Artificial Sequence: Synthetic peptide
AELVGAGVRGNFYDWFVDQLV

SEQ ID NO: 150 - protein, 21 aa, Artificial Sequence
  Description of Artificial Sequence: Synthetic peptide
DSSRLWLGERNFYDWFVAQIS

SEQ ID NO: 151 - protein, 21 aa, Artificial Sequence
  Description of Artificial Sequence: Synthetic peptide
VGQVGRYVRSNFYDWFVQQAM

SEQ ID NO: 152 - protein, 21 aa, Artificial Sequence
  Description of Artificial Sequence: Synthetic peptide
RPQLVESGSKNFYDWFVQVVR

SEQ ID NO: 153 - protein, 21 aa, Artificial Sequence
  Description of Artificial Sequence: Synthetic peptide
RIHNQTERGGNFYDWFVHQLV

SEQ ID NO: 154 - protein, 21 aa, Artificial Sequence
  Description of Artificial Sequence: Synthetic peptide
EMYGDTSERVNFYDWFVSALQ

SEQ ID NO: 155 - protein, 21 aa, Artificial Sequence
  Description of Artificial Sequence: Synthetic peptide
RVGSGMEDLGNFYDWFVRQAQ

SEQ ID NO: 156 - protein, 21 aa, Artificial Sequence
  Description of Artificial Sequence: Synthetic peptide
KDPVTVSQGRNFYDWFVVQIQ

SEQ ID NO: 157 - protein, 22 aa, Artificial Sequence
  Description of Artificial Sequence: Synthetic peptide
DARDHGVWVMSNFYDWFVAQVS

SEQ ID NO: 158 - protein, 21 aa, Artificial Sequence
  Description of Artificial Sequence: Synthetic peptide
VATVHVGGGMNFYDWFVAQVG

SEQ ID NO: 159 - protein, 21 aa, Artificial Sequence
  Description of Artificial Sequence: Synthetic peptide
CADPGACSSLNFYDWFVQMRG

SEQ ID NO: 160 - protein, 21 aa, Artificial Sequence
  Description of Artificial Sequence: Synthetic peptide
NPTSVQQYGVNFYDWFVNVLS

SEQ ID NO: 161 - protein, 21 aa, Artificial Sequence
  Description of Artificial Sequence: Synthetic peptide
RPSLPEVRPGNFYDWFVQSVR

SEQ ID NO: 162 - protein, 21 aa, Artificial Sequence
  Description of Artificial Sequence: Synthetic peptide
SLQGADFQQGNFYDWFVSELA

SEQ ID NO: 163 - protein, 21 aa, Artificial Sequence
  Description of Artificial Sequence: Synthetic peptide
LSSRGRVTMRNFYDWFVAQVV

SEQ ID NO: 164 - protein, 21 aa, Artificial Sequence
  Description of Artificial Sequence: Synthetic peptide
HKSWTTMSPLNFYDWFVAQVE

SEQ ID NO: 165 - protein, 21 aa, Artificial Sequence
  Description of Artificial Sequence: Synthetic peptide
RPVIGGGGTRNFYDWFVAQMI

SEQ ID NO: 166 - protein, 21 aa, Artificial Sequence
  Description of Artificial Sequence: Synthetic peptide
YDQDPPYWGLNFYDWFVREVA

SEQ ID NO: 167 - protein, 39 aa, Artificial Sequence; identical to SEQ ID NO: 5
  Description of Artificial Sequence: Synthetic peptide

SEQ ID NO: 168 - protein, 39 aa, Artificial Sequence
  Description of Artificial Sequence: Synthetic peptide
QRGMLVRGRISHGAGKIAYEPPDCLGQKACAVNFYDWFV

SEQ ID NO: 169 - protein, 39 aa, Artificial Sequence
  Description of Artificial Sequence: Synthetic peptide
QRGMLLLGRISDDAGKVASEPSARRGQKVFAFNFYDWFV

SEQ ID NO: 170 - protein, 38 aa, Artificial Sequence
  Description of Artificial Sequence: Synthetic peptide
YRGILVLGRISEGAGKVASEPAARIGQKVFADFYDWFV

SEQ ID NO: 171 - protein, 39 aa, Artificial Sequence
  Description of Artificial Sequence: Synthetic peptide
QRGMLALGRISDGAGKVASEPPAGIGQKVFAFNFYDWFV

SEQ ID NO: 172 - protein, 39 aa, Artificial Sequence
  Description of Artificial Sequence: Synthetic peptide
FRGRLVLGHFSDGAGKVGSEPAARIGQKVFDVNFYDWFV

SEQ ID NO: 173 - protein, 39 aa, Artificial Sequence
  Description of Artificial Sequence: Synthetic peptide
YRGMLVLGRISDGAGKVASEPPARIGQEVFADNFYDWFV

SEQ ID NO: 174 - protein, 39 aa, Artificial Sequence
  Description of Artificial Sequence: Synthetic peptide
YRGMLVLGRISDGAGEVASEPPARIGQEVFALNFYDWFV

SEQ ID NO: 175 - protein, 39 aa, Artificial Sequence
  Description of Artificial Sequence: Synthetic peptide
VPWYAGSGSSSDGAGKVASEPPARIDQKVFAVNFYDWFV

SEQ ID NO: 176 - protein, 39 aa, Artificial Sequence
  Description of Artificial Sequence: Synthetic peptide
YRGQLVLGRISYGAGKVGCDPPARIGQKDWAVNFYDWFV

SEQ ID NO: 177 - protein, 39 aa, Artificial Sequence
  Description of Artificial Sequence: Synthetic peptide
QRGLLVLGRFSDGAGNVASEPPAGIGQEVFPVNFYDWFV

SEQ ID NO: 178 - protein, 39 aa, Artificial Sequence
  Description of Artificial Sequence: Synthetic peptide
QRGMLVLGRISDGAGKVAAEPPDCLGQKVCAVNFYDWFV

SEQ ID NO: 179 - protein, 39 aa, Artificial Sequence
  Description of Artificial Sequence: Synthetic peptide
QRGMRVLGRISDGAGKVASELPPRIGQKDFAVNFYDWFV

SEQ ID NO: 180 - protein, 39 aa, Artificial Sequence
  Description of Artificial Sequence: Synthetic peptide
QRGMLVLGSISDGAGKVAYEAPARIGQTVFAVNFYDWFV

SEQ ID NO: 181 - protein, 39 aa, Artificial Sequence
  Description of Artificial Sequence: Synthetic peptide
QPWCAGSGRIYDGACKVASEPPAHIGQEVFAVNFYDWFV

SEQ ID NO: 182 - protein, 39 aa, Artificial Sequence
  Description of Artificial Sequence: Synthetic peptide
QRGMLVLDRISDGAGKVASGPPARIGQNVLAVNFYDWFV

SEQ ID NO: 183 - protein, 39 aa, Artificial Sequence
  Description of Artificial Sequence: Synthetic peptide
YRGMLVVGRISDGTGKVASQPPARIGQKVFAVNFYDWFV

SEQ ID NO: 184 - protein, 39 aa, Artificial Sequence
  Description of Artificial Sequence: Synthetic peptide
YRGMLVLGRISDGAGKVASVPPAHIGQKVFAFNFYDWFV

SEQ ID NO: 185 - protein, 39 aa, Artificial Sequence
  Description of Artificial Sequence: Synthetic peptide
QHGMLVLGRVSVGAGKVPSEPQARIGHKVFDVNFYDWFV

SEQ ID NO: 186 - protein, 39 aa, Artificial Sequence
  Description of Artificial Sequence: Synthetic peptide
YSGYAGSGSFSDGAGKVASEPPARISQEVLADNFYDWFV

SEQ ID NO: 187 - protein, 39 aa, Artificial Sequence
  Description of Artificial Sequence: Synthetic peptide
YRGMLVLGRISDGAGKVASEPPARIGQKVSAVNFYDWFV

SEQ ID NO: 188 - protein, 39 aa, Artificial Sequence
  Description of Artificial Sequence: Synthetic peptide
YHGKLDLGRISVGVGKVASEPPARIGQKVFADNFYDWFV

SEQ ID NO: 189 - protein, 40 aa, Artificial Sequence
  Description of Artificial Sequence: Synthetic peptide
YRGQAGSGVGSLTVAGKVASDPPARIGQKVFADNFYDWFV

SEQ ID NO: 190 - protein, 39 aa, Artificial Sequence
  Description of Artificial Sequence: Synthetic peptide
HRGMLVLGRISEGAGNVDPEPPARIGQNVFAGNFYDWFV

SEQ ID NO: 191 - protein, 39 aa, Artificial Sequence
  Description of Artificial Sequence: Synthetic peptide
QRGMPVLGRISDGAGKVGSEPPARIARKVFPVNFYDWFI

SEQ ID NO: 192 - protein, 39 aa, Artificial Sequence
  Description of Artificial Sequence: Synthetic peptide
QGGLLVTGRISDGAGKVASEPPGGIGQKVFAGNFYDWFV

SEQ ID NO: 193 - protein, 39 aa, Artificial Sequence
  Description of Artificial Sequence: Synthetic peptide
YPWYGGSGTYLDGAGKVASEPPARIDQQVFAGNFYDWFV

SEQ ID NO: 194 - protein, 39 aa, Artificial Sequence
  Description of Artificial Sequence: Synthetic peptide
YRAMLVLRRISDVAGIVDSEPPTRIGQKVFAGNFYDWFV

SEQ ID NO: 195 - protein, 39 aa, Artificial Sequence
  Description of Artificial Sequence: Synthetic peptide
YRGMLVLGRISQGAGNVASEPSSRIGQKVFAGNFYDWFI

SEQ ID NO: 196 - protein, 39 aa, Artificial Sequence
  Description of Artificial Sequence: Synthetic peptide
YRGMLVLGRISDGAGKVDYEPPARIGQKVFAGNFYDWFV

SEQ ID NO: 197 - protein, 39 aa, Artificial Sequence
  Description of Artificial Sequence: Synthetic peptide
YRGMLGLGGISAGAGIVASEPPARVGQKVFAGNFYDWFV

SEQ ID NO: 198 - protein, 39 aa, Artificial Sequence
  Description of Artificial Sequence: Synthetic peptide
YRGILFQGRIPDGAGKVASEPPTRIGERVFAVNFYDWFV

SEQ ID NO: 199 - protein, 39 aa, Artificial Sequence
  Description of Artificial Sequence: Synthetic peptide
QGGMPVLGRISDGAGKVAFEPPARIGQKVFAGNFYDWFV

SEQ ID NO: 200 - protein, 39 aa, Artificial Sequence
  Description of Artificial Sequence: Synthetic peptide
YRGMLVLGRIQDGAGKVASEPPARIGQKVFTGNFYDWFV

SEQ ID NO: 201 - protein, 39 aa, Artificial Sequence
  Description of Artificial Sequence: Synthetic peptide
QRGMLVLGGVSDGAGKVASDPPASIGQNVFAVNFYDWFV

SEQ ID NO: 202 - protein, 39 aa, Artificial Sequence
  Description of Artificial Sequence: Synthetic peptide
YPGMLILDRISDGASKVVSEPPASIGQKVFAVNFYDWFV

SEQ ID NO: 203 - protein, 39 aa, Artificial Sequence
  Description of Artificial Sequence: Synthetic peptide
YRGMLVLDRISDGAGKVASEQPARIGQEVYAVNFYDWFV

SEQ ID NO: 204 - protein, 39 aa, Artificial Sequence
  Description of Artificial Sequence: Synthetic peptide
YRGMLDLGRISGGVGKVASESPARIGQKVYAVNFYDWFV

SEQ ID NO: 205 - protein, 32 aa, Artificial Sequence
  Description of Artificial Sequence: Synthetic peptide
QRGMMVLGRISDGAGEVASEKVFAVNFYDWFV

SEQ ID NO: 206 - protein, 39 aa, Artificial Sequence
  Description of Artificial Sequence: Synthetic peptide
QRGMLVLGRVSDGAGKVDSAPPARIGQKVFAGNFYDWFV

SEQ ID NO: 207 - protein, 39 aa, Artificial Sequence
  Description of Artificial Sequence: Synthetic peptide
QRGMLVLGRMSDGAGKVAFEPPARIGQRGFAGNFYDWFV

SEQ ID NO: 208 - protein, 39 aa, Artificial Sequence
  Description of Artificial Sequence: Synthetic peptide
QRGTLVLGRISDGAGKAASEPPARIGQNVFAVNFYDWFV

SEQ ID NO: 209 - protein, 39 aa, Artificial Sequence
  Description of Artificial Sequence: Synthetic peptide
QRGMLVLDRISDGAGKVAAEPPARIGQKVFALNFYDWFI

SEQ ID NO: 210 - protein, 39 aa, Artificial Sequence
  Description of Artificial Sequence: Synthetic peptide
QRGMLVLGRISDGAGEVASEPPARIGEKVYAVNFYDWFV

SEQ ID NO: 211 - protein, 39 aa, Artificial Sequence
  Description of Artificial Sequence: Synthetic peptide
QRGILVRGRISDGAGKVGSEPPARSGEKVFAVNFYDWFI

SEQ ID NO: 212 - protein, 39 aa, Artificial Sequence
  Description of Artificial Sequence: Synthetic peptide
QLGMVVLGRISDGSGKAASEPAARISQKVFAVNFYDWFV

SEQ ID NO: 213 - protein, 39 aa, Artificial Sequence
  Description of Artificial Sequence: Synthetic peptide
QRGMLVLGRISDGDGKVASEPPARIGQRVFAVNFYDWFV

SEQ ID NO: 214 - protein, 39 aa, Artificial Sequence
  Description of Artificial Sequence: Synthetic peptide
YRGMLVLGRSSDGAGKVAFERPARIGQTVFAVNFYDWFV

SEQ ID NO: 215 - protein, 39 aa, Artificial Sequence
  Description of Artificial Sequence: Synthetic peptide
  MOD_RES (16): Unknown amino acid; translation read-through at TAA stop codon
YRGMLVLGRISDGAGXVASEPPARIGRKVFAVNFYDWFV

SEQ ID NO: 216 - protein, 39 aa, Artificial Sequence
  Description of Artificial Sequence: Synthetic peptide
YRGMLVLGRISGGAGKAASERPARIGQKVSAVNFYDWFV

SEQ ID NO: 217 - protein, 39 aa, Artificial Sequence
  Description of Artificial Sequence: Synthetic peptide
YRGMMVQGRISDGAGKVASVSPVRIGQKVIAVNFYDWFV

SEQ ID NO: 218 - protein, 39 aa, Artificial Sequence
  Description of Artificial Sequence: Synthetic peptide
YRGRLGLGRISDVAGKVACDPSARIGQKVLPVNFYDWFV

SEQ ID NO: 219 - protein, 39 aa, Artificial Sequence
  Description of Artificial Sequence: Synthetic peptide
YRGMLVLGRISDGAGRVASEPQARIGQKVFAVNFYDWFV

SEQ ID NO: 220 - protein, 39 aa, Artificial Sequence
  Description of Artificial Sequence: Synthetic peptide
QGGMLVPGRISDGAGKVASQPPARIGPKGFAGNFYDWFV

SEQ ID NO: 221 - protein, 39 aa, Artificial Sequence
  Description of Artificial Sequence: Synthetic peptide
YRGMRVLGRISDGAGKVASEPPTHIGQKVFPVNFYDWFV

SEQ ID NO: 222 - protein, 39 aa, Artificial Sequence
  Description of Artificial Sequence: Synthetic peptide
YRGMLVLGRISDGAGKVGSEPAARIGQKVFALNFYDWFV

SEQ ID NO: 223 - protein, 40 aa, Artificial Sequence
  Description of Artificial Sequence: Synthetic peptide
YRGQGMVLGRISDGAGKVASEPPGRIGQKVFPVNFYDWFV

SEQ ID NO: 224 - protein, 39 aa, Artificial Sequence
  Description of Artificial Sequence: Synthetic peptide
YRGMLGLGRITGGAGKVASEPPDRIGQHVFVDNFYDWFV

SEQ ID NO: 225 - protein, 38 aa, Artificial Sequence
  Description of Artificial Sequence: Synthetic peptide
DGMLVLGRISDGAGNVASEAPARIGQKVFAVNFYDWFV

SEQ ID NO: 226 - protein, 39 aa, Artificial Sequence
  Description of Artificial Sequence: Synthetic peptide
YRGMRVRGRISDGAGKAASDPRARIGQTVLDVNFYDWFV

SEQ ID NO: 227 - protein, 39 aa, Artificial Sequence
  Description of Artificial Sequence: Synthetic peptide
YRGMWVLGRISYGAGKVAYEPPARMGQKGFAVNFYDWFV

SEQ ID NO: 228 - protein, 39 aa, Artificial Sequence
  Description of Artificial Sequence: Synthetic peptide
YRGMLVGGRIAGGAGIVASEPPARIGQKVFAVNFYDWFV

SEQ ID NO: 229 - protein, 39 aa, Artificial Sequence
  Description of Artificial Sequence: Synthetic peptide
YRGLLGLGGISDGAGKVASEPPARNGQKVFAVNFYDWFV

SEQ ID NO: 230 - protein, 39 aa, Artificial Sequence
  Description of Artificial Sequence: Synthetic peptide
YRGMLGLGRISAGAGKVASGAPARIGQEDFAVNFYDWFV

SEQ ID NO: 231 - protein, 39 aa, Artificial Sequence
  Description of Artificial Sequence: Synthetic peptide
YRGMLALGRISEGAGKVASEPPARIGQNVFAVNFYDWFV

SEQ ID NO: 232 - protein, 39 aa, Artificial Sequence
  Description of Artificial Sequence: Synthetic peptide
YRGMLVLGRISDGAGKVASEPPARIGQKVLAVNFYDWFV

SEQ ID NO: 233 - protein, 39 aa, Artificial Sequence
  Description of Artificial Sequence: Synthetic peptide
YPGMLVPGRISDGAGEGATDPPPRIGQKVFAFNFYDWFV

SEQ ID NO: 234 - protein, 39 aa, Artificial Sequence
  Description of Artificial Sequence: Synthetic peptide
YRGMLVPGRISDGAGKVAYEPPARIGQKIFAVNFYDWFV

SEQ ID NO: 235 - protein, 39 aa, Artificial Sequence
  Description of Artificial Sequence: Synthetic peptide
YRGVLVLGRVSDGVGKVASEPPAHRGQRVFGVNFYDWFV

SEQ ID NO: 236 - protein, 39 aa, Artificial Sequence
  Description of Artificial Sequence: Synthetic peptide
YRRMLVLGRISDGAANVASGPPDRIGQKVFAGNFYDWFV

SEQ ID NO: 237 - protein, 39 aa, Artificial Sequence
  Description of Artificial Sequence: Synthetic peptide
YRRMLALGRFSDVTGDVASEPPAHIGQKVVAVNFYDWFV

SEQ ID NO: 238 - protein, 39 aa, Artificial Sequence
  Description of Artificial Sequence: Synthetic peptide
YRGMVVRGRIFDGPGKVASEPRARIGQKVFAVNFYDWFV

SEQ ID NO: 239 - protein, 39 aa, Artificial Sequence
  Description of Artificial Sequence: Synthetic peptide
YRGMLILGRISDGAGKVASEPPARVGQDVVAVNFYDWFV

SEQ ID NO: 240 - protein, 39 aa, Artificial Sequence
  Description of Artificial Sequence: Synthetic peptide
YPGRLVGGRISDGVGKVASEPPGRIGQKVFAVNFYDWFV

SEQ ID NO: 241 - protein, 39 aa, Artificial Sequence
  Description of Artificial Sequence: Synthetic peptide
QRGLLVLGRIFDGAGKVASDPPARIGQKDFADNFYDWFV

SEQ ID NO: 242 - protein, 39 aa, Artificial Sequence
  Description of Artificial Sequence: Synthetic peptide
YRGMLVLGRISDGAGKVAFEPPARIGQNVFAVNFYDWFV

SEQ ID NO: 243 - protein, 39 aa, Artificial Sequence
  Description of Artificial Sequence: Synthetic peptide
  MOD_RES (16): Unknown amino acid; translation read-through at TAA stop codon
YRCMPVLGRISDGAGXVASDRPARIGQKVFAVNFYDWFV

SEQ ID NO: 244 - protein, 39 aa, Artificial Sequence
  Description of Artificial Sequence: Synthetic peptide
YRGRLVLGRISDGAGKVAAEPPASMDSKVFAGNFYDWFV

SEQ ID NO: 245 - protein, 16 aa, Artificial Sequence
  Description of Artificial Sequence: Synthetic peptide
GFREGNFYDWFVAQVT

SEQ ID NO: 246 - protein, 16 aa, Artificial Sequence
  Description of Artificial Sequence: Synthetic peptide
GFREGQRWYWFVAQVT

SEQ ID NO: 247 - protein, 16 aa, Artificial Sequence
  Description of Artificial Sequence: Synthetic peptide
GFREGYFYDWFLAQVT

SEQ ID NO: 248 - protein, 16 aa, Artificial Sequence
  Description of Artificial Sequence: Synthetic peptide
GFREGDFYEWFVAQVT

SEQ ID NO: 249 - protein, 16 aa, Artificial Sequence
  Description of Artificial Sequence: Synthetic peptide
GFREGQFYEWFAAQVT

SEQ ID NO: 250 - protein, 16 aa, Artificial Sequence
  Description of Artificial Sequence: Synthetic peptide
GFREGTFYDWFVAQVT

SEQ ID NO: 251 - protein, 16 aa, Artificial Sequence
  Description of Artificial Sequence: Synthetic peptide
GFREGNFYDWFEAQVT

SEQ ID NO: 252 - protein, 16 aa, Artificial Sequence
  Description of Artificial Sequence: Synthetic peptide
GFREGAFYDWFEAQVT

SEQ ID NO: 253 - protein, 16 aa, Artificial Sequence
  Description of Artificial Sequence: Synthetic peptide
GFREGAFYDWFVAQVT

SEQ ID NO: 254 - protein, 16 aa, Artificial Sequence
  Description of Artificial Sequence: Synthetic peptide
GFREGKFYQWFEAQVT

SEQ ID NO: 255 - protein, 16 aa, Artificial Sequence
  Description of Artificial Sequence: Synthetic peptide
GFREGDFYDWFQAQVT

SEQ ID NO: 256 - protein, 16 aa, Artificial Sequence
  Description of Artificial Sequence: Synthetic peptide
GFREGTFYEWFVAQVT

SEQ ID NO: 257 - protein, 16 aa, Artificial Sequence
  Description of Artificial Sequence: Synthetic peptide
GFREGNFYDWFVAQVT

SEQ ID NO: 258 - protein, 16 aa, Artificial Sequence
  Description of Artificial Sequence: Synthetic peptide
GFREGQFYEWFLAQVT

SEQ ID NO: 259 - protein, 16 aa, Artificial Sequence
  Description of Artificial Sequence: Synthetic peptide
GFREGQFYDWFLAQVT

SEQ ID NO: 260 - protein, 16 aa, Artificial Sequence
  Description of Artificial Sequence: Synthetic peptide
GFREGEFYDWFQAQVT

SEQ ID NO: 261 - protein, 16 aa, Artificial Sequence
  Description of Artificial Sequence: Synthetic peptide
GFREGQFYDWFRAQVT

SEQ ID NO: 262 - protein, 16 aa, Artificial Sequence
  Description of Artificial Sequence: Synthetic peptide
GFREGYFYEWFQAQVT

SEQ ID NO: 263 - protein, 16 aa, Artificial Sequence
  Description of Artificial Sequence: Synthetic peptide
GFREGDFYQWFEAQVT

SEQ ID NO: 264 - protein, 16 aa, Artificial Sequence
  Description of Artificial Sequence: Synthetic peptide
GFREGSFYGWFQAQVT

SEQ ID NO: 265 - protein, 16 aa, Artificial Sequence
  Description of Artificial Sequence: Synthetic peptide
GFREGSFYAWFQAQVT

SEQ ID NO: 266 - protein, 16 aa, Artificial Sequence
  Description of Artificial Sequence: Synthetic peptide
GFREGQFYDWFVAQVT

SEQ ID NO: 267 - protein, 16 aa, Artificial Sequence
  Description of Artificial Sequence: Synthetic peptide
GFREGIFYEWFVAQVT

SEQ ID NO: 268 - protein, 16 aa, Artificial Sequence
  Description of Artificial Sequence: Synthetic peptide
GFREGSFYEWFQAQVT

SEQ ID NO: 269 - protein, 16 aa, Artificial Sequence
  Description of Artificial Sequence: Synthetic peptide
GFREGNFYDWFAAQVT

SEQ ID NO: 270 - protein, 16 aa, Artificial Sequence
  Description of Artificial Sequence: Synthetic peptide
GFREGSFYDWFVAQVT

SEQ ID NO: 271 - protein, 16 aa, Artificial Sequence
  Description of Artificial Sequence: Synthetic peptide
GFREGDFYDWFVAQVT

SEQ ID NO: 272 - protein, 16 aa, Artificial Sequence
  Description of Artificial Sequence: Synthetic peptide
GFREGDFYQWFVAQVT

SEQ ID NO: 273 - protein, 16 aa, Artificial Sequence
  Description of Artificial Sequence: Synthetic peptide
GFREGGFYDWFVAQVT

SEQ ID NO: 274 - protein, 16 aa, Artificial Sequence
  Description of Artificial Sequence: Synthetic peptide
GFREGDFYGWFQAQVT

SEQ ID NO: 275 - protein, 16 aa, Artificial Sequence
  Description of Artificial Sequence: Synthetic peptide
GFREGVFYDWFVAQVT

SEQ ID NO: 276 - protein, 16 aa, Artificial Sequence
  Description of Artificial Sequence: Synthetic peptide
GFREGGFYEWFQAQVT

SEQ ID NO: 277 - protein, 16 aa, Artificial Sequence
  Description of Artificial Sequence: Synthetic peptide
GFREGSFYDWFQAQVT

SEQ ID NO: 278 - protein, 16 aa, Artificial Sequence
  Description of Artificial Sequence: Synthetic peptide
GFREGNFYEWFQAQVT

SEQ ID NO: 279 - protein, 16 aa, Artificial Sequence
  Description of Artificial Sequence: Synthetic peptide
GFREGKFYDWFLAQVT

SEQ ID NO: 280 - protein, 16 aa, Artificial Sequence
  Description of Artificial Sequence: Synthetic peptide
GFREGEFYEWFVAQVT

SEQ ID NO: 281 - protein, 16 aa, Artificial Sequence
  Description of Artificial Sequence: Synthetic peptide
GFREGRFYDWFVAQVT

SEQ ID NO: 282 - protein, 16 aa, Artificial Sequence
  Description of Artificial Sequence: Synthetic peptide
GFREGTFYDWFVAQVT

SEQ ID NO: 283 - protein, 16 aa, Artificial Sequence
  Description of Artificial Sequence: Synthetic peptide
GFREGEFYEWFAAQVT

SEQ ID NO: 284 - protein, 16 aa, Artificial Sequence
  Description of Artificial Sequence: Synthetic peptide
GFREGDFYEWFEAQVT

SEQ ID NO: 285 - protein, 16 aa, Artificial Sequence
  Description of Artificial Sequence: Synthetic peptide
  MOD_RES (12): Unknown amino acid
GFREGHFYDWFXAQVT

SEQ ID NO: 286 - protein, 16 aa, Artificial Sequence
  Description of Artificial Sequence: Synthetic peptide
GFREGEFYDWFVAQVT

SEQ ID NO: 287 - protein, 16 aa, Artificial Sequence
  Description of Artificial Sequence: Synthetic peptide
GFREGSFYDWFVAQVT

SEQ ID NO: 288 - protein, 16 aa, Artificial Sequence
  Description of Artificial Sequence: Synthetic peptide
GFREGSFYDWFGAQVT

SEQ ID NO: 289 - protein, 16 aa, Artificial Sequence
  Description of Artificial Sequence: Synthetic peptide
GFREGTFYDWFQAQVT

SEQ ID NO: 290 - protein, 16 aa, Artificial Sequence
  Description of Artificial Sequence: Synthetic peptide
GFREGNFYEWFTAQVT

SEQ ID NO: 291 - protein, 16 aa, Artificial Sequence
  Description of Artificial Sequence: Synthetic peptide
GFREGSFYNWFQAQVT

SEQ ID NO: 292 - protein, 16 aa, Artificial Sequence
  Description of Artificial Sequence: Synthetic peptide
GFREGNFYDWFVAQVT

SEQ ID NO: 293 - protein, 16 aa, Artificial Sequence
  Description of Artificial Sequence: Synthetic peptide
GFREGDFYDWFVAQVT

SEQ ID NO: 294 - protein, 16 aa, Artificial Sequence
  Description of Artificial Sequence: Synthetic peptide
GFREGAFYDWFAAQVT

SEQ ID NO: 295 - protein, 16 aa, Artificial Sequence
  Description of Artificial Sequence: Synthetic peptide
GFREGSFYDWFEAQVT

SEQ ID NO: 296 - protein, 16 aa, Artificial Sequence
  Description of Artificial Sequence: Synthetic peptide
GFREGSFYDWFAAQVT

SEQ ID NO: 297 - protein, 16 aa, Artificial Sequence
  Description of Artificial Sequence: Synthetic peptide
GFREGSFYEWFDAQVT

SEQ ID NO: 298 - protein, 16 aa, Artificial Sequence
  Description of Artificial Sequence: Synthetic peptide
GFREGAFYDWFEAQVT

SEQ ID NO: 299 - protein, 16 aa, Artificial Sequence
  Description of Artificial Sequence: Synthetic peptide
GFREGQFYDWFAAQVT

SEQ ID NO: 300 - protein, 16 aa, Artificial Sequence
  Description of Artificial Sequence: Synthetic peptide
GFREGNFYDWFAAQVT

SEQ ID NO: 301 - protein, 16 aa, Artificial Sequence
  Description of Artificial Sequence: Synthetic peptide
GFREGDFYDWFAAQVT

SEQ ID NO: 302 - protein, 16 aa, Artificial Sequence
  Description of Artificial Sequence: Synthetic peptide
GFREGSFYEWFEAQVT

SEQ ID NO: 303 - protein, 16 aa, Artificial Sequence
  Description of Artificial Sequence: Synthetic peptide
GFREGGFYDWFLAQVT

SEQ ID NO: 304 - protein, 16 aa, Artificial Sequence
  Description of Artificial Sequence: Synthetic peptide
GFREGGFYAWFAAQVT

SEQ ID NO: 305 - protein, 16 aa, Artificial Sequence
  Description of Artificial Sequence: Synthetic peptide
  MOD_RES (12): Unknown amino acid
GFREGGFYEWFXAQVT

SEQ ID NO: 306 - protein, 16 aa, Artificial Sequence
  Description of Artificial Sequence: Synthetic peptide
GFREGDFYDWFRAQVT

SEQ ID NO: 307 - protein, 16 aa, Artificial Sequence
  Description of Artificial Sequence: Synthetic peptide
GFREGSFYDWFVAQVT

SEQ ID NO: 308 - protein, 16 aa, Artificial Sequence
  Description of Artificial Sequence: Synthetic peptide
GFREGDFYGWFQAQVT

SEQ ID NO: 309 - protein, 16 aa, Artificial Sequence
  Description of Artificial Sequence: Synthetic peptide
GFREGGFYDWFQAQVT

SEQ ID NO: 310 - protein, 16 aa, Artificial Sequence
  Description of Artificial Sequence: Synthetic peptide
GFREGDFYDWFVAQVT

SEQ ID NO: 311 - protein, 16 aa, Artificial Sequence
  Description of Artificial Sequence: Synthetic peptide
GFREGDFYDWFQAQVT

SEQ ID NO: 312 - protein, 16 aa, Artificial Sequence
  Description of Artificial Sequence: Synthetic peptide
GFREGGFYDWFVAQVT

SEQ ID NO: 313 - protein, 16 aa, Artificial Sequence
  Description of Artificial Sequence: Synthetic peptide
GFREGDFYDWFAAQVT

SEQ ID NO: 314 - protein, 16 aa, Artificial Sequence
  Description of Artificial Sequence: Synthetic peptide
GFREGNFYDWFQAQVT

SEQ ID NO: 315 - protein, 16 aa, Artificial Sequence
  Description of Artificial Sequence: Synthetic peptide
GFREGNFYDWFLAQVT

SEQ ID NO: 316 - protein, 16 aa, Artificial Sequence
  Description of Artificial Sequence: Synthetic peptide
GFREGHFYDWFQAQVT

SEQ ID NO: 317 - protein, 16 aa, Artificial Sequence
  Description of Artificial Sequence: Synthetic peptide
GFREGQFYEWFEAQVT

SEQ ID NO: 318 - protein, 16 aa, Artificial Sequence
  Description of Artificial Sequence: Synthetic peptide
GFREGSFYEWFQAQVT

SEQ ID NO: 319 - protein, 16 aa, Artificial Sequence
  Description of Artificial Sequence: Synthetic peptide
GFREGDFYDWFLAQVT

SEQ ID NO: 320 - protein, 16 aa, Artificial Sequence
  Description of Artificial Sequence: Synthetic peptide
GFREGHFYDWFVAQVT

SEQ ID NO: 321 - protein, 16 aa, Artificial Sequence
  Description of Artificial Sequence: Synthetic peptide
GFREGQFYEWFVAQVT

SEQ ID NO: 322 - protein, 16 aa, Artificial Sequence
  Description of Artificial Sequence: Synthetic peptide
GFREGQFYDWFAAQVT

SEQ ID NO: 323 - protein, 16 aa, Artificial Sequence
  Description of Artificial Sequence: Synthetic peptide
GFREGQFYDWFVAQVT

SEQ ID NO: 324 - protein, 16 aa, Artificial Sequence
  Description of Artificial Sequence: Synthetic peptide
GFREGDFYQWFAAQVT

SEQ ID NO: 325 - protein, 16 aa, Artificial Sequence
  Description of Artificial Sequence: Synthetic peptide
GFREGNFYDWFVAQVT

SEQ ID NO: 326 - protein, 16 aa, Artificial Sequence
  Description of Artificial Sequence: Synthetic peptide
GFRDGSFYDWFVAQVT

SEQ ID NO: 327 - protein, 16 aa, Artificial Sequence
  Description of Artificial Sequence: Synthetic peptide
GFREGHFYEWFQAQVT

SEQ ID NO: 328 - protein, 16 aa, Artificial Sequence
  Description of Artificial Sequence: Synthetic peptide
GFREGDFYDWFSAQVT

SEQ ID NO: 329 - protein, 16 aa, Artificial Sequence
  Description of Artificial Sequence: Synthetic peptide
GFREGHFYDWFDAQVT

SEQ ID NO: 330 - protein, 16 aa, Artificial Sequence
  Description of Artificial Sequence: Synthetic peptide
GFREGYFYDWFKAQVT

SEQ ID NO: 331 - protein, 16 aa, Artificial Sequence
  Description of Artificial Sequence: Synthetic peptide
GFREGHFYDWFEAQVT

SEQ ID NO: 332 - protein, 16 aa, Artificial Sequence
  Description of Artificial Sequence: Synthetic peptide
GFREGDFYDWFEAQVT

SEQ ID NO: 333 - protein, 16 aa, Artificial Sequence
  Description of Artificial Sequence: Synthetic peptide
GFREGTFYDWFVAQVT

SEQ ID NO: 334 - protein, 16 aa, Artificial Sequence
  Description of Artificial Sequence: Synthetic peptide
GFREGDYYGWFEAQVT

SEQ ID NO: 335 - protein, 16 aa, Artificial Sequence
  Description of Artificial Sequence: Synthetic peptide
GFREGDFYAWFMAQVT

SEQ ID NO: 336 - protein, 16 aa, Artificial Sequence
  Description of Artificial Sequence: Synthetic peptide
GFREGNFYEWFLAQVT

SEQ ID NO: 337 - protein, 16 aa, Artificial Sequence
  Description of Artificial Sequence: Synthetic peptide
GFREGSFYDWFDAQVT

SEQ ID NO: 338 - protein, 16 aa, Artificial Sequence
  Description of Artificial Sequence: Synthetic peptide
GFREGNFYDQFVAQVT

SEQ ID NO: 339 - protein, 16 aa, Artificial Sequence
  Description of Artificial Sequence: Synthetic peptide
GFREGHFYEWFAAQVT

SEQ ID NO: 340 - protein, 16 aa, Artificial Sequence
  Description of Artificial Sequence: Synthetic peptide
GFREGNFYEWFVAQVT

SEQ ID NO: 341 - protein, 16 aa, Artificial Sequence
  Description of Artificial Sequence: Synthetic peptide
GFREGKFYDWFVAQVT

SEQ ID NO: 342 - protein, 16 aa, Artificial Sequence
  Description of Artificial Sequence: Synthetic peptide
GFREGMFDVQLLAQVT

SEQ ID NO: 343 - protein, 26 aa, Artificial Sequence
  Description of Artificial Sequence: Synthetic peptide
  MOD_RES (1)..(6): Variable amino acid
  MOD_RES (21)..(26): Variable amino acid
XXXXXXFHENFYDWFVRQVSXXXXXX

SEQ ID NO: 344 - protein, 21 aa, Artificial Sequence
  Description of Artificial Sequence: Synthetic peptide
VTFTSAVFHENFYDWFVRQVS

SEQ ID NO: 345 - protein, 26 aa, Artificial Sequence
  Description of Artificial Sequence: Synthetic peptide
TYKARFLHENFYDWFNRQVSQYFGRV

SEQ ID NO: 346 - protein, 24 aa, Artificial Sequence
  Description of Artificial Sequence: Synthetic peptide
QRLSLHEQFYDWFVGQVSPLGAGG

SEQ ID NO: 347 - protein, 26 aa, Artificial Sequence
  Description of Artificial Sequence: Synthetic peptide
GGGKVNFHEDFYGWFVQQFSGVGSDR

SEQ ID NO: 348 - protein, 26 aa, Artificial Sequence
  Description of Artificial Sequence: Synthetic peptide
LVGDAPFHEDFYDWFARQVFGCCQEQ

SEQ ID NO: 349 - protein, 26 aa, Artificial Sequence
  Description of Artificial Sequence: Synthetic peptide
TGAEVSFHENFYDWFDRQYSSWLDRD

SEQ ID NO: 350 - protein, 26 aa, Artificial Sequence
  Description of Artificial Sequence: Synthetic peptide
QPHSSRLHESFYDWFDRQVPWYALDR

SEQ ID NO: 351 - protein, 26 aa, Artificial Sequence
  Description of Artificial Sequence: Synthetic peptide
SRALAAVHEQFYDWFVRQVSGLDWGY

SEQ ID NO: 352 - protein, 26 aa, Artificial Sequence
  Description of Artificial Sequence: Synthetic peptide
QPKDGTLHENFYDWFVRQVSSSGWVG

SEQ ID NO: 353 - protein, 26 aa, Artificial Sequence
  Description of Artificial Sequence: Synthetic peptide
RGRLIQLHEDFYDWFLRQVSGMGGGS

SEQ ID NO: 354 - protein, 26 aa, Artificial Sequence
  Description of Artificial Sequence: Synthetic peptide
QRGAPKSDENFYDWFVRQVLRFGEND

SEQ ID NO: 355 - protein, 26 aa, Artificial Sequence
  Description of Artificial Sequence: Synthetic peptide
AARTSLFHEDFYEWFDRQVRQEGMWG

SEQ ID NO: 356 - protein, 26 aa, Artificial Sequence
  Description of Artificial Sequence: Synthetic peptide
GTSNHSLHENFYDWFVRQLSSVQSSG

SEQ ID NO: 357 - protein, 26 aa, Artificial Sequence
  Description of Artificial Sequence: Synthetic peptide
VSHVHLFHENFYDWFVRQLAAEGFSG

SEQ ID NO: 358 - protein, 26 aa, Artificial Sequence
  Description of Artificial Sequence: Synthetic peptide
GRQDSGLHEHFYDWFSRQVQGEVALG

SEQ ID NO: 359 - protein, 26 aa, Artificial Sequence
  Description of Artificial Sequence: Synthetic peptide
SNDERQFHETFYDWFVRQVSADGADR

SEQ ID NO: 360 - protein, 26 aa, Artificial Sequence
  Description of Artificial Sequence: Synthetic peptide
LSTEQRFHEKFYDWFVHQVSTSGGGT

SEQ ID NO: 361 - protein, 26 aa, Artificial Sequence
  Description of Artificial Sequence: Synthetic peptide
SLSREQFHENFYDWFARQVSELEGVV

SEQ ID NO: 362 - protein, 26 aa, Artificial Sequence
  Description of Artificial Sequence: Synthetic peptide
IPGRRSLHENFYDWFVRQVSPGGGSA

SEQ ID NO: 363 - protein, 26 aa, Artificial Sequence
  Description of Artificial Sequence: Synthetic peptide
TQKAQSLDEKFYDWFVRQVSGGGLTG

SEQ ID NO: 364 - protein, 26 aa, Artificial Sequence
  Description of Artificial Sequence: Synthetic peptide
VSQLSDFHENFYGWFARQIAGQAEWT

SEQ ID NO: 365 - protein, 26 aa, Artificial Sequence
  Description of Artificial Sequence: Synthetic peptide
NGTSQALHQNFYDWFAQQISGSEPGP

SEQ ID NO: 366 - protein, 26 aa, Artificial Sequence
  Description of Artificial Sequence: Synthetic peptide
VGQSVTFHGDFYDWFDRQLSGSQEFG

SEQ ID NO: 367 - protein, 26 aa, Artificial Sequence
  Description of Artificial Sequence: Synthetic peptide
TIDHHPLHEQFYDWFARQVSDLESLG

SEQ ID NO: 368 - protein, 26 aa, Artificial Sequence
  Description of Artificial Sequence: Synthetic peptide
PNVGYAFHENFYDWFIRQVSIEEKAG

SEQ ID NO: 369 - protein, 26 aa, Artificial Sequence
  Description of Artificial Sequence: Synthetic peptide
SRGSGVFHESFYNWFDRQVSEWIQFG

SEQ ID NO: 370 - protein, 26 aa, Artificial Sequence
  Description of Artificial Sequence: Synthetic peptide
QPVSGSVHERFYDWFVRQVSGSAGGG

SEQ ID NO: 371 - protein, 26 aa, Artificial Sequence
  Description of Artificial Sequence: Synthetic peptide
ASQLPPVYENFYEWFDRQVSLDAQRE

SEQ ID NO: 372 - protein, 26 aa, Artificial Sequence
  Description of Artificial Sequence: Synthetic peptide
VSGRGAFHENFYDWFVRQVFRDEQDT

SEQ ID NO: 373 - protein, 26 aa, Artificial Sequence
  Description of Artificial Sequence: Synthetic peptide
ARPPPTVHENFYDWFVRQVSETWRQD

SEQ ID NO: 374 - protein, 26 aa, Artificial Sequence
  Description of Artificial Sequence: Synthetic peptide
QGGDRLFHERFYDWFDRLVSSDSTGE

SEQ ID NO: 375 - protein, 26 aa, Artificial Sequence
  Description of Artificial Sequence: Synthetic peptide
QHIAAGLHENFYDWFIRQVSGVNVPA

SEQ ID NO: 376 - protein, 26 aa, Artificial Sequence
  Description of Artificial Sequence: Synthetic peptide
QPNDGLLHENFYDWFVRQVSNAVDGG

SEQ ID NO: 377 - protein, 26 aa, Artificial Sequence
  Description of Artificial Sequence: Synthetic peptide
PVEFTVYHDNFYDWFARQVSDGLGQF

SEQ ID NO: 378 - protein, 26 aa, Artificial Sequence
  Description of Artificial Sequence: Synthetic peptide
FCVQASIHENFYDWFVRQVAENQVFS

SEQ ID NO: 379 - protein, 26 aa, Artificial Sequence
  Description of Artificial Sequence: Synthetic peptide
GRPRGSFHENFYDWFARQVSGDGAGT

SEQ ID NO: 380 - protein, 26 aa, Artificial Sequence
  Description of Artificial Sequence: Synthetic peptide
IVGASLCHESFYDWFACQVTNLQSQG

SEQ ID NO: 381 - protein, 26 aa, Artificial Sequence
  Description of Artificial Sequence: Synthetic peptide
IGLRQMFHENFYDWFAREVSKEAGDG

SEQ ID NO: 382 - protein, 26 aa, Artificial Sequence
  Description of Artificial Sequence: Synthetic peptide
LGGAIEGHGNFYDWFVRQVSLDVGGE

SEQ ID NO: 383 - protein, 26 aa, Artificial Sequence
  Description of Artificial Sequence: Synthetic peptide
LNALQQLHENFYDWFGRQVSATPPGG

SEQ ID NO: 384 - protein, 26 aa, Artificial Sequence
  Description of Artificial Sequence: Synthetic peptide
VGNCDTFPENFYDWFACQVSELGGMN

SEQ ID NO: 385 - protein, 26 aa, Artificial Sequence
  Description of Artificial Sequence: Synthetic peptide
FSQDGNFHENFYDWFDRQLSLVGAGT

SEQ ID NO: 386 - protein, 26 aa, Artificial Sequence
  Description of Artificial Sequence: Synthetic peptide
PAGNRALHESFYDWFVRQVSEFQLGA

SEQ ID NO: 387 - protein, 26 aa, Artificial Sequence
  Description of Artificial Sequence: Synthetic peptide
DRLRARFNENFYDWFDRQVSGQGSMP

SEQ ID NO: 388 - protein, 26 aa, Artificial Sequence
  Description of Artificial Sequence: Synthetic peptide
VLGVAQFHDKFYDWFARQVSQLESAG

SEQ ID NO: 389 - protein, 26 aa, Artificial Sequence
  Description of Artificial Sequence: Synthetic peptide
GVVGGAFHEQFYDWFDRQVSAAFKGD

SEQ ID NO: 390 - protein, 26 aa, Artificial Sequence
  Description of Artificial Sequence: Synthetic peptide
DESEMRLHEQFYDWFARLVSLEGGSA

SEQ ID NO: 391 - protein, 26 aa, Artificial Sequence
  Description of Artificial Sequence: Synthetic peptide
EGGGVAIHENFYDWFDRQVSLQGWSD

SEQ ID NO: 392 - protein, 26 aa, Artificial Sequence
  Description of Artificial Sequence: Synthetic peptide
SRIVSRFHENFYDWFVRQVSGDAPVQ

SEQ ID NO: 393 - protein, 26 aa, Artificial Sequence
  Description of Artificial Sequence: Synthetic peptide
IPAGAQLHENFYDWFARQVSGEDGGA

SEQ ID NO: 394 - protein, 26 aa, Artificial Sequence
  Description of Artificial Sequence: Synthetic peptide
GSSAAGFDEQFYDWFDRQVSEAFRDG

SEQ ID NO: 395 - protein, 26 aa, Artificial Sequence
  Description of Artificial Sequence: Synthetic peptide
RLALRTFHQDFYDWFVRQVAAEDTDP

SEQ ID NO: 396 - protein, 26 aa, Artificial Sequence
  Description of Artificial Sequence: Synthetic peptide
QGSFAVLHENFYDWFARQVSGVEGLA

SEQ ID NO: 397 - protein, 26 aa, Artificial Sequence
  Description of Artificial Sequence: Synthetic peptide
QGNMSALHENFYDWFVRQVSEADRVD

SEQ ID NO: 398 - protein, 26 aa, Artificial Sequence
  Description of Artificial Sequence: Synthetic peptide
VAYPALLHEQFYDWFVRQVSAVAGTT

SEQ ID NO: 399 - protein, 26 aa, Artificial Sequence
  Description of Artificial Sequence: Synthetic peptide
PDTINSQHKNFYDWFVRQVSGVGTSS

SEQ ID NO: 400 - protein, 26 aa, Artificial Sequence
  Description of Artificial Sequence: Synthetic peptide
SEDVDSRHENFYDWFVRQVSGIGLQD

SEQ ID NO: 401 - protein, 26 aa, Artificial Sequence
  Description of Artificial Sequence: Synthetic peptide
PAPADAFDHNFYDWFARQLSATTTIQ

SEQ ID NO: 402 - protein, 26 aa, Artificial Sequence
  Description of Artificial Sequence: Synthetic peptide
MVQRISIHENFYDWFVRQISGSAVPP

SEQ ID NO: 403 - protein, 26 aa, Artificial Sequence
  Description of Artificial Sequence: Synthetic peptide
GNVRGQFHGQFYDWFARQVSGSEGDA

SEQ ID NO: 404 - protein, 26 aa, Artificial Sequence
  Description of Artificial Sequence: Synthetic peptide
PDAEKQFHETFYGWFVRQISEDSANS

SEQ ID NO: 405 - protein, 26 aa, Artificial Sequence
  Description of Artificial Sequence: Synthetic peptide
FGRGVHCDENFYDWFVCQVSGALLEG

SEQ ID NO: 406 - protein, 26 aa, Artificial Sequence
  Description of Artificial Sequence: Synthetic peptide
ETPLTELHEQFYDWFVRQVSGFPGGV

SEQ ID NO: 407 - protein, 26 aa, Artificial Sequence
  Description of Artificial Sequence: Synthetic peptide
QHRGPHFHEDFYDWFVRQVSSAVPSD

SEQ ID NO: 408 - protein, 26 aa, Artificial Sequence
  Description of Artificial Sequence: Synthetic peptide
RQDPGLFHDNFYDWFDRLVSAWDGQE

SEQ ID NO: 409 - protein, 26 aa, Artificial Sequence
  Description of Artificial Sequence: Synthetic peptide
QAAVGVCNKDFYAWFACQVREDFAKA

SEQ ID NO: 410 - protein, 26 aa, Artificial Sequence
  Description of Artificial Sequence: Synthetic peptide
RNWNLQFNENFYDWFDRQVSALRGGG

SEQ ID NO: 411 - protein, 26 aa, Artificial Sequence
  Description of Artificial Sequence: Synthetic peptide
RSEQYRFHENFYEWFDRQVSRMGLLG

SEQ ID NO: 412 - protein, 26 aa, Artificial Sequence
  Description of Artificial Sequence: Synthetic peptide
GAGGRDFDEDFYDWFVRQVSGQVTSG

SEQ ID NO: 413 - protein, 26 aa, Artificial Sequence
  Description of Artificial Sequence: Synthetic peptide
SPEGNLVHDQFYDWFVRQLSSTSAGT

SEQ ID NO: 414 - protein, 26 aa, Artificial Sequence
  Description of Artificial Sequence: Synthetic peptide
QGGLGDFDEDFYDWFARQVSRRDRAD

SEQ ID NO: 415 - protein, 26 aa, Artificial Sequence
  Description of Artificial Sequence: Synthetic peptide
LSQGVGFQENFYEWFERQVSGWDGRD

SEQ ID NO: 416 - protein, 26 aa, Artificial Sequence
  Description of Artificial Sequence: Synthetic peptide
VFERSRCHDNFYDWFFCQVSGQADGG

SEQ ID NO: 417 - protein, 26 aa, Artificial Sequence
  Description of Artificial Sequence: Synthetic peptide
LLASRAFHENFYDWFARQVSGTQPPG

SEQ ID NO: 418 - protein, 26 aa, Artificial Sequence
  Description of Artificial Sequence: Synthetic peptide
VPDAQIFHESFYDWFVRQASAGGPAD

SEQ ID NO: 419 - protein, 26 aa, Artificial Sequence
  Description of Artificial Sequence: Synthetic peptide
ANQMGRFHDNFYDWFDRQVSRYERGT

SEQ ID NO: 420 - protein, 26 aa, Artificial Sequence
  Description of Artificial Sequence: Synthetic peptide
PSRKDGLHQSFYDWFARQVQDMEGRA

SEQ ID NO: 421 - protein, 26 aa, Artificial Sequence
  Description of Artificial Sequence: Synthetic peptide
QAVTRRFHENFYDWFARQVSEEGGWS

SEQ ID NO: 422 - protein, 26 aa, Artificial Sequence
  Description of Artificial Sequence: Synthetic peptide
GYAVGQYQANFYDWFVRQVDGMSNGG

SEQ ID NO: 423 - protein, 26 aa, Artificial Sequence
  Description of Artificial Sequence: Synthetic peptide
GHQRDLLHESFYDWFVRQVSEAEGGG

SEQ ID NO: 424 - protein, 26 aa, Artificial Sequence
  Description of Artificial Sequence: Synthetic peptide
DRPSSFIHENFYEWFARQVSQSGSSG

SEQ ID NO: 425 - protein, 26 aa, Artificial Sequence
  Description of Artificial Sequence: Synthetic peptide
ERTAETLHEQFYDWFVRQVSAMDGES

SEQ ID NO: 426 - protein, 26 aa, Artificial Sequence
  Description of Artificial Sequence: Synthetic peptide
LTSQLLSHEDFYDWFVRQVSGVGGSG

SEQ ID NO: 427 - protein, 26 aa, Artificial Sequence
  Description of Artificial Sequence: Synthetic peptide
PDRSDRLDDNFYDWFVRQVSQVINED

SEQ ID NO: 428 - protein, 26 aa, Artificial Sequence
  Description of Artificial Sequence: Synthetic peptide
RAGGVGLHDNFYDWFVRQVSGGDSGP

SEQ ID NO: 429 - protein, 26 aa, Artificial Sequence
  Description of Artificial Sequence: Synthetic peptide
ADCYVQLHENFYDWFRRQVCNLQEGM

SEQ ID NO: 430 - protein, 26 aa, Artificial Sequence
  Description of Artificial Sequence: Synthetic peptide
RQGHAGFHDNFYDWFVRQVSGSTPQV

SEQ ID NO: 431 - protein, 21 aa, Artificial Sequence
  Description of Artificial Sequence: Synthetic peptide
VTFTSAVFHENFYDWFVRQVS

SEQ ID NO: 432 - protein, 26 aa, Artificial Sequence
  Description of Artificial Sequence: Synthetic peptide
GIISQSCPESFYDWFAGQVSDPWWCW

SEQ ID NO: 433 - protein, 26 aa, Artificial Sequence
  Description of Artificial Sequence: Synthetic peptide
VGRASGFPENFYDWFGRQLSLQSGEQ

SEQ ID NO: 434 - protein, 26 aa, Artificial Sequence
  Description of Artificial Sequence: Synthetic peptide
VGYQGQGDENFYDWFIRQVSGRLGVQ

SEQ ID NO: 435 - protein, 26 aa, Artificial Sequence
  Description of Artificial Sequence: Synthetic peptide
SACQFDCHENFYDWFARQVSGGAAYG

SEQ ID NO: 436 - protein, 26 aa, Artificial Sequence
  Description of Artificial Sequence: Synthetic peptide
SAAQLFFQESFYDWFLRQVAESSQPN

SEQ ID NO: 437 - protein, 26 aa, Artificial Sequence
  Description of Artificial Sequence: Synthetic peptide
AVRATRFDEAFYDWFVRQISDGQGNK

SEQ ID NO: 438 - protein, 26 aa, Artificial Sequence
  Description of Artificial Sequence: Synthetic peptide
VNQSGSIHENFYDWFERQVSHQRGVR

SEQ ID NO: 439 - protein, 26 aa, Artificial Sequence
  Description of Artificial Sequence: Synthetic peptide
APDPSDFQEIFYDWFVRQVSRMPGGG

SEQ ID NO: 440 - protein, 25 aa, Artificial Sequence
  Description of Artificial Sequence: Synthetic peptide
SSCDGAGHESFYEWFVRQVSGCRSV

SEQ ID NO: 441 - protein, 26 aa, Artificial Sequence
  Description of Artificial Sequence: Synthetic peptide
RAGSSDFHEDFYEWFVRQVSLSLKGK

SEQ ID NO: 442 - protein, 26 aa, Artificial Sequence
  Description of Artificial Sequence: Synthetic peptide
QAVQPGFHEEFYDWFVRQVSTGVGGG

SEQ ID NO: 443 - protein, 26 aa, Artificial Sequence
  Description of Artificial Sequence: Synthetic peptide
SSIGGGFHENFYDWFSRQLSQSPPLK

SEQ ID NO: 444 - protein, 26 aa, Artificial Sequence
  Description of Artificial Sequence: Synthetic peptide
QSPVGSSHEDFYDWFFRQVAQSGAHQ

SEQ ID NO: 445 - protein, 26 aa, Artificial Sequence
  Description of Artificial Sequence: Synthetic peptide
NYRRQVFNGNFYDWFDRQVFSLVTPG

SEQ ID NO: 446 - protein, 26 aa, Artificial Sequence
  Description of Artificial Sequence: Synthetic peptide
TLDGGSFEEQFYDWFVRQLSYRTNPD

SEQ ID NO: 447 - protein, 26 aa, Artificial Sequence
  Description of Artificial Sequence: Synthetic peptide
FYVQQWGHENFYDWFDRQVSQSGGAG

SEQ ID NO: 448 - protein, 26 aa, Artificial Sequence
  Description of Artificial Sequence: Synthetic peptide
LRRQAPVEENFYDWFVRQVSGDRVGG

SEQ ID NO: 449 - protein, 26 aa, Artificial Sequence
  Description of Artificial Sequence: Synthetic peptide
RCGRELYHSTFYDWFDRQVAGRTCPS

SEQ ID NO: 450 - protein, 26 aa, Artificial Sequence
  Description of Artificial Sequence: Synthetic peptide
CCLLCRFQQNFYDWFVCQGISRLRPL

SEQ ID NO: 451 - protein, 26 aa, Artificial Sequence
  Description of Artificial Sequence: Synthetic peptide
PPLASDLDVQFYGWFVQQVSPPGRGG

SEQ ID NO: 452 - protein, 25 aa, Artificial Sequence
  Description of Artificial Sequence: Synthetic peptide
GAPVDQLHEDFYDWFVRQVSQAATG

SEQ ID NO: 453 - protein, 26 aa, Artificial Sequence
  Description of Artificial Sequence: Synthetic peptide
RSASGSLPEQFYDWFVRQVSLSGTDK

SEQ ID NO: 454 - protein, 26 aa, Artificial Sequence
  Description of Artificial Sequence: Synthetic peptide
SRVTTVFHENFYDWFVRQLSDSAISG

SEQ ID NO: 455 - protein, 26 aa, Artificial Sequence
  Description of Artificial Sequence: Synthetic peptide
DERGGKFREDFYDWFVRQVSESRFGQ

SEQ ID NO: 456 - protein, 26 aa, Artificial Sequence
  Description of Artificial Sequence: Synthetic peptide
RGAVAGFHDQFYDWFDRQVSRVHKFG

SEQ ID NO: 457 - protein, 26 aa, Artificial Sequence
  Description of Artificial Sequence: Synthetic peptide
AICDAGFHEHFYDWFALQVSDCGRQS

SEQ ID NO: 458 - protein, 26 aa, Artificial Sequence
  Description of Artificial Sequence: Synthetic peptide
LGYQEPFQQNFYDWFVRQVSGAENAG

SEQ ID NO: 459 - protein, 26 aa, Artificial Sequence
  Description of Artificial Sequence: Synthetic peptide
WRGHGTFHEDFYDWFVRQVSGSGSST

SEQ ID NO: 460 - protein, 26 aa, Artificial Sequence
  Description of Artificial Sequence: Synthetic peptide
GGRVGVLHENFYDWFDRQVSLRGADG

SEQ ID NO: 461 - protein, 26 aa, Artificial Sequence
  Description of Artificial Sequence: Synthetic peptide
CNLTAGFHEQFYHWFAIQVCGDAENA

SEQ ID NO: 462 - protein, 26 aa, Artificial Sequence
  Description of Artificial Sequence: Synthetic peptide
ERGEDMFHENFYDWFVRQISGRQGGG

SEQ ID NO: 463 - protein, 26 aa, Artificial Sequence
  Description of Artificial Sequence: Synthetic peptide
TNQGVGFYDSFYGWFVRQIQYGVDSG

SEQ ID NO: 464 - protein, 26 aa, Artificial Sequence
  Description of Artificial Sequence: Synthetic peptide
HLADGQFHEKFYDWFERQISSRCNDC

SEQ ID NO: 465 - protein, 26 aa, Artificial Sequence
  Description of Artificial Sequence: Synthetic peptide
QTFGKSLHENFYDWFVRQVSREEGGD

SEQ ID NO: 466 - protein, 26 aa, Artificial Sequence
  Description of Artificial Sequence: Synthetic peptide
FRTLAAQHDSFYDWFDRQVSGAAGER

SEQ ID NO: 467 - protein, 26 aa, Artificial Sequence
  Description of Artificial Sequence: Synthetic peptide
SASTHQFHENFYDWFVRQVSGAQKIL

SEQ ID NO: 468 - protein, 21 aa, Artificial Sequence
  Description of Artificial Sequence: Synthetic peptide
  MOD_RES (1)..(6): Variable amino acid
  MOD_RES (9)..(10): Variable amino acid
  MOD_RES (13): Variable amino acid
  MOD_RES (16)..(21): Variable amino acid
XXXXXXFHXXFYXWFXXXXXX

SEQ ID NO: 469 - protein, 21 aa, Artificial Sequence
  Description of Artificial Sequence: Synthetic peptide
VTFTSAVFHENFYDWFVRQVS

SEQ ID NO: 470 - protein, 20 aa, Artificial Sequence
  Description of Artificial Sequence: Synthetic peptide
  MOD_RES (19): Unknown amino acid; translation read-through at TGA stop codon
QSDSGTVHDRFYGWFRDTXA

SEQ ID NO: 471 - protein, 21 aa, Artificial Sequence
  Description of Artificial Sequence: Synthetic peptide
WTDVDGFHSGFYRWFQNQWER

SEQ ID NO: 472 - protein, 21 aa, Artificial Sequence
  Description of Artificial Sequence: Synthetic peptide
VASGHVLHGQFYRWFVDQFAL

SEQ ID NO: 473 - protein, 21 aa, Artificial Sequence
  Description of Artificial Sequence: Synthetic peptide
QARVGNVHQQFYEWFREVMQG

SEQ ID NO: 474 - protein, 21 aa, Artificial Sequence
  Description of Artificial Sequence: Synthetic peptide
VGDFCVSHDCFYGWFLRESMQ

SEQ ID NO: 475 - protein, 20 aa, Artificial Sequence
  Description of Artificial Sequence: Synthetic peptide
SGSRPVFHEQFYEWFVDQLG

SEQ ID NO: 476 - protein, 21 aa, Artificial Sequence
  Description of Artificial Sequence: Synthetic peptide
QFSAGAFHGDFYGWFRALYNG

SEQ ID NO: 477 - protein, 21 aa, Artificial Sequence
  Description of Artificial Sequence: Synthetic peptide
SRFDERLHHQFYEWFRVLNEP

SEQ ID NO: 478 - protein, 21 aa, Artificial Sequence
  Description of Artificial Sequence: Synthetic peptide
DSVNSDLHRAFYGWFAEQWRA

SEQ ID NO: 479 - protein, 21 aa, Artificial Sequence
  Description of Artificial Sequence: Synthetic peptide
GSVDREIHGPFYSWFSEQLWG

SEQ ID NO: 480 - protein, 21 aa, Artificial Sequence
  Description of Artificial Sequence: Synthetic peptide
SAKTPVLHDGFYMWFEAQSES

SEQ ID NO: 481 - protein, 21 aa, Artificial Sequence
  Description of Artificial Sequence: Synthetic peptide
LVVGRRFHQSFYDWFVAAAGG

SEQ ID NO: 482 - protein, 21 aa, Artificial Sequence
  Description of Artificial Sequence: Synthetic peptide
IMWPCTFQDPFYCWFQTEQGR

SEQ ID NO: 483 - protein, 21 aa, Artificial Sequence
  Description of Artificial Sequence: Synthetic peptide
VVGPLDIHERFYGWFHQQGGA

SEQ ID NO: 484 - protein, 21 aa, Artificial Sequence
  Description of Artificial Sequence: Synthetic peptide
VVPKAGFHEAFYEWFRRQDRD

SEQ ID NO: 485 - protein, 21 aa, Artificial Sequence
  Description of Artificial Sequence: Synthetic peptide
QSFVTSVHTRFYAWFASALEM

SEQ ID NO: 486 - protein, 21 aa, Artificial Sequence
  Description of Artificial Sequence: Synthetic peptide
SRGLGLYHSGFYGWFERQFNQ

SEQ ID NO: 487 - protein, 21 aa, Artificial Sequence
  Description of Artificial Sequence: Synthetic peptide
GADTGAVHRRFYLWFEQLSGG

SEQ ID NO: 488 - protein, 21 aa, Artificial Sequence
  Description of Artificial Sequence: Synthetic peptide
PGNRPTFHAEFYRWFREAQGS

SEQ ID NO: 489 - protein, 21 aa, Artificial Sequence
  Description of Artificial Sequence: Synthetic peptide
VAVAWGLHESFYAWFENQFSD

SEQ ID NO: 490 - protein, 21 aa, Artificial Sequence
  Description of Artificial Sequence: Synthetic peptide
GFNTGTFHDQFYYWFWEAAGG

SEQ ID NO: 491 - protein, 21 aa, Artificial Sequence
  Description of Artificial Sequence: Synthetic peptide
GDGLTAFHQGFYEWFDIQMYG

SEQ ID NO: 492 - protein, 21 aa, Artificial Sequence
  Description of Artificial Sequence: Synthetic peptide
VGVNRQFHTRFYAWFDEQLGG

SEQ ID NO: 493 - protein, 21 aa, Artificial Sequence
  Description of Artificial Sequence: Synthetic peptide
GPRGQRLHDAFYSWFDALRVN

SEQ ID NO: 494 - protein, 21 aa, Artificial Sequence
  Description of Artificial Sequence: Synthetic peptide
LGTLAVFHELFYGWFERQLGG

SEQ ID NO: 495 - protein, 21 aa, Artificial Sequence
  Description of Artificial Sequence: Synthetic peptide
LGGYCGFNCQFYRWFDNLADR

SEQ ID NO: 496 - protein, 21 aa, Artificial Sequence
  Description of Artificial Sequence: Synthetic peptide
FSGWADYQSGFYQWFAEELAN

SEQ ID NO: 497 - protein, 21 aa, Artificial Sequence
  Description of Artificial Sequence: Synthetic peptide
WGPFSVFDESFYRWFAQASDD

SEQ ID NO: 498 - protein, 21 aa, Artificial Sequence
  Description of Artificial Sequence: Synthetic peptide
PRNEGLVHGLFYDWFQRALSG

SEQ ID NO: 499 - protein, 21 aa, Artificial Sequence
  Description of Artificial Sequence: Synthetic peptide
DEGGAPLDVMFYRWFEQAVRG

SEQ ID NO: 500 - protein, 21 aa, Artificial Sequence
  Description of Artificial Sequence: Synthetic peptide
QSGNRGSHGAFYSWFRDVLAN

SEQ ID NO: 501 - protein, 21 aa, Artificial Sequence
  Description of Artificial Sequence: Synthetic peptide
MRQRDGFNSSFYGWFAAALGE

SEQ ID NO: 502 - protein, 21 aa, Artificial Sequence
  Description of Artificial Sequence: Synthetic peptide
SEERKKVHSQFYSWFDRQLLG

SEQ ID NO: 503 - protein, 21 aa, Artificial Sequence
  Description of Artificial Sequence: Synthetic peptide
PSPNAPFHGGFYDWFDWVQGS

SEQ ID NO: 504 - protein, 21 aa, Artificial Sequence
  Description of Artificial Sequence: Synthetic peptide
FHRPGSFNTNFYQWFDDQMNQ

SEQ ID NO: 505 - protein, 21 aa, Artificial Sequence
  Description of Artificial Sequence: Synthetic peptide
SDDSSTLNGRFYTWFHMQLLD

SEQ ID NO: 506 - protein, 21 aa, Artificial Sequence
  Description of Artificial Sequence: Synthetic peptide
QRGGGGFHEGFYSWFRSQSLL

SEQ ID NO: 507 - protein, 21 aa, Artificial Sequence
  Description of Artificial Sequence: Synthetic peptide
SGSRPVFHEQFYEWFVDQLGL

SEQ ID NO: 508 - protein, 21 aa, Artificial Sequence
  Description of Artificial Sequence: Synthetic peptide
GGSSQAFHGAFYEWFSAQLRG

SEQ ID NO: 509 - protein, 21 aa, Artificial Sequence
  Description of Artificial Sequence: Synthetic peptide
AFVSERVNQRFYDWFRDQMRS

SEQ ID NO: 510 - protein, 21 aa, Artificial Sequence
  Description of Artificial Sequence: Synthetic peptide
VRHPTRFHDEFYRWFTEQLTT

SEQ ID NO: 511 - protein, 21 aa, Artificial Sequence
  Description of Artificial Sequence: Synthetic peptide
ARLLNIFDRGFYNWFQRQLDE

SEQ ID NO: 512 - protein, 21 aa, Artificial Sequence
  Description of Artificial Sequence: Synthetic peptide
PSLSSNLHESFYRWFDQLVST

SEQ ID NO: 513 - protein, 21 aa, Artificial Sequence
  Description of Artificial Sequence: Synthetic peptide
FAFGLGFHQGFYDWFAHQLEG

SEQ ID NO: 514 - protein, 21 aa, Artificial Sequence
  Description of Artificial Sequence: Synthetic peptide
VSATVMLHREFYDWFGLQLLD

SEQ ID NO: 515 - protein, 21 aa, Artificial Sequence
  Description of Artificial Sequence: Synthetic peptide
GGVSGVLHDRFYSWFERQLAG

SEQ ID NO: 516 - protein, 21 aa, Artificial Sequence
  Description of Artificial Sequence: Synthetic peptide
GLGIASFHEGFYSWFTAQLGA

SEQ ID NO: 517 - protein, 21 aa, Artificial Sequence
  Description of Artificial Sequence: Synthetic peptide
RVDAAALNAGFYEWFRGVIQG

SEQ ID NO: 518 - protein, 21 aa, Artificial Sequence
  Description of Artificial Sequence: Synthetic peptide
GGAGRSFHDAFYEWFERQMAG

SEQ ID NO: 519 - protein, 21 aa, Artificial Sequence
  Description of Artificial Sequence: Synthetic peptide
EGARQGFHARFYSWFAQQLAL

SEQ ID NO: 520 - protein, 21 aa, Artificial Sequence
  Description of Artificial Sequence: Synthetic peptide
VLLPGVVHGGFYDWFSRQLSS

SEQ ID NO: 521 - protein, 21 aa, Artificial Sequence
  Description of Artificial Sequence: Synthetic peptide
GALSDRYNNVFYDWFREQLLG

SEQ ID NO: 522 - protein, 21 aa, Artificial Sequence
  Description of Artificial Sequence: Synthetic peptide
PDSFMSLHQRFYSWFQAQVGT

SEQ ID NO: 523 - protein, 21 aa, Artificial Sequence
  Description of Artificial Sequence: Synthetic peptide
RVYKANFHNEFYGWFREQLLG

SEQ ID NO: 524 - protein, 21 aa, Artificial Sequence
  Description of Artificial Sequence: Synthetic peptide
HSGMRDVHARFYSWFSEQLSG

SEQ ID NO: 525 - protein, 21 aa, Artificial Sequence
  Description of Artificial Sequence: Synthetic peptide
ARLLERFQDPFYEWFETLMGD

SEQ ID NO: 526 - protein, 21 aa, Artificial Sequence
  Description of Artificial Sequence: Synthetic peptide
RNSSGNFHDKFYNWFEAQLKG

SEQ ID NO: 527 - protein, 21 aa, Artificial Sequence
  Description of Artificial Sequence: Synthetic peptide
GSMSPVFNDQFYGWFRDLVDE

SEQ ID NO: 528 - protein, 21 aa, Artificial Sequence
  Description of Artificial Sequence: Synthetic peptide
SCTGRQFDGCFYAWFEDQLVG

SEQ ID NO: 529 - protein, 21 aa, Artificial Sequence
  Description of Artificial Sequence: Synthetic peptide
GIAVQSLHDSFYRWFDNALGS

SEQ ID NO: 530 - protein, 21 aa, Artificial Sequence
  Description of Artificial Sequence: Synthetic peptide
IGPPGSLHRGFYDWFAEQVEA

SEQ ID NO: 531 - protein, 21 aa, Artificial Sequence
  Description of Artificial Sequence: Synthetic peptide
GAAGISFHRGFYDWFAAQVRD

SEQ ID NO: 532 - protein, 21 aa, Artificial Sequence
  Description of Artificial Sequence: Synthetic peptide
GVDVTDFHKDFYSWFQRQLNG

SEQ ID NO: 533 - protein, 21 aa, Artificial Sequence
  Description of Artificial Sequence: Synthetic peptide
WAGRAGIHGGFYEWFNRQLRG

SEQ ID NO: 534 - protein, 21 aa, Artificial Sequence
  Description of Artificial Sequence: Synthetic peptide
LGQLAAFHLGFYEWFSEAVAA

SEQ ID NO: 535 - protein, 21 aa, Artificial Sequence
  Description of Artificial Sequence: Synthetic peptide
VHSVSRLNVGFYQWFQDQLSG

SEQ ID NO: 536 - protein, 21 aa, Artificial Sequence
  Description of Artificial Sequence: Synthetic peptide
LGLMAIFDRGFYGWFEQQLSG

SEQ ID NO: 537 - protein, 21 aa, Artificial Sequence
  Description of Artificial Sequence: Synthetic peptide
VARGSSLHDDFYEWFASQLRT

SEQ ID NO: 538 - protein, 21 aa, Artificial Sequence
  Description of Artificial Sequence: Synthetic peptide
LGYIGALNTQFYSWFADLVGS

SEQ ID NO: 539 - protein, 21 aa, Artificial Sequence
  Description of Artificial Sequence: Synthetic peptide
EDSRLRLHEGFYGWFRKQLGD

SEQ ID NO: 540 - protein, 21 aa, Artificial Sequence
  Description of Artificial Sequence: Synthetic peptide
GRDNMKFHSGFYDWFTQQLAG

SEQ ID NO: 541 - protein, 21 aa, Artificial Sequence
  Description of Artificial Sequence: Synthetic peptide
AGVMGGFHQEFYLWFERALSN

SEQ ID NO: 542 - protein, 21 aa, Artificial Sequence
  Description of Artificial Sequence: Synthetic peptide
AGHVGQVYDGFYGWFREQLGA

SEQ ID NO: 543 - protein, 21 aa, Artificial Sequence
  Description of Artificial Sequence: Synthetic peptide
FVQNIGFDYDFYGWFVREVEK

SEQ ID NO: 544 - protein, 21 aa, Artificial Sequence
  Description of Artificial Sequence: Synthetic peptide
PVGIGGLHRAFYQWFQSQVDA

SEQ ID NO: 545 - protein, 21 aa, Artificial Sequence
  Description of Artificial Sequence: Synthetic peptide
GSRQEADHQAFYDWFNLVLGV

SEQ ID NO: 546 - protein, 21 aa, Artificial Sequence
  Description of Artificial Sequence: Synthetic peptide
AGGRKPFHDDFYGWFRDQLAE

SEQ ID NO: 547 - protein, 21 aa, Artificial Sequence
  Description of Artificial Sequence: Synthetic peptide
DLASHGFHDAFYNWFSVQLNS

SEQ ID NO: 548 - protein, 21 aa, Artificial Sequence
  Description of Artificial Sequence: Synthetic peptide
GSNGGGVHGQFYAWFVEALSG

SEQ ID NO: 549 - protein, 21 aa, Artificial Sequence
  Description of Artificial Sequence: Synthetic peptide
RGRASTFHDGFYGWFSQQLRF

SEQ ID NO: 550 - protein, 21 aa, Artificial Sequence
  Description of Artificial Sequence: Synthetic peptide
SPARRVSHHDFYGWFAKQLES

SEQ ID NO: 551 - protein, 21 aa, Artificial Sequence
  Description of Artificial Sequence: Synthetic peptide
SSDVGAFHSAFYDWFKAQLSG

SEQ ID NO: 552 - protein, 21 aa, Artificial Sequence
  Description of Artificial Sequence: Synthetic peptide
PTVHRAFDDLFYGWFAKQVED

SEQ ID NO: 553 - protein, 21 aa, Artificial Sequence
  Description of Artificial Sequence: Synthetic peptide
SSNTVGLDERFYAWFVDQLGA

SEQ ID NO: 554 - protein, 21 aa, Artificial Sequence
  Description of Artificial Sequence: Synthetic peptide
PGAAEGFHSAFYDWFAQAVSG

SEQ ID NO: 555 - protein, 21 aa, Artificial Sequence
  Description of Artificial Sequence: Synthetic peptide
MRSEASFHVEFYSWFEEQLRS

SEQ ID NO: 556 - protein, 21 aa, Artificial Sequence
  Description of Artificial Sequence: Synthetic peptide
VSRYGGQQDGFYHWFSDLLKG

SEQ ID NO: 557 - protein, 21 aa, Artificial Sequence
  Description of Artificial Sequence: Synthetic peptide
RPSSGGLHYGFYHWFRVQEEM

SEQ ID NO: 558 - protein, 21 aa, Artificial Sequence
  Description of Artificial Sequence: Synthetic peptide
SNIEEHFHMQFYRWFSDALGN

SEQ ID NO: 559 - protein, 21 aa, Artificial Sequence
  Description of Artificial Sequence: Synthetic peptide
ANDCLGLHAGFYGWFACQLGG

SEQ ID NO: 560 - protein, 21 aa, Artificial Sequence
  Description of Artificial Sequence: Synthetic peptide
TGHRLGLDEQFYWWFRDALSG

SEQ ID NO: 561 - protein, 21 aa, Artificial Sequence
  Description of Artificial Sequence: Synthetic peptide
VLTSNTLHQRFYSWFAAARRE

SEQ ID NO: 562 - protein, 21 aa, Artificial Sequence
  Description of Artificial Sequence: Synthetic peptide
CVAQGGFQSSFYCWFAGLDID

SEQ ID NO: 563 - protein, 21 aa, Artificial Sequence
  Description of Artificial Sequence: Synthetic peptide
NGQSSRFHTAFYDWFAAQLSG

SEQ ID NO: 564 - protein, 21 aa, Artificial Sequence
  Description of Artificial Sequence: Synthetic peptide
SVPRGTVHDAFYQWFREVALG

SEQ ID NO: 565 - protein, 21 aa, Artificial Sequence
  Description of Artificial Sequence: Synthetic peptide
GARGSTFHDQFYEWFWVQLGD

SEQ ID NO: 566 - protein, 21 aa, Artificial Sequence
  Description of Artificial Sequence: Synthetic peptide
PPGMNGFHTSFYSWFVDQLGD

SEQ ID NO: 567 - protein, 21 aa, Artificial Sequence
  Description of Artificial Sequence: Synthetic peptide
AVGTLGYHSGFYRWFERQLGG

SEQ ID NO: 568 - protein, 21 aa, Artificial Sequence
  Description of Artificial Sequence: Synthetic peptide
ELQARGVHRNFYRWFEAQVSG

SEQ ID NO: 569 - protein, 21 aa, Artificial Sequence
  Description of Artificial Sequence: Synthetic peptide
HRVARAFHEQFYDWFEKAVSG

SEQ ID NO: 570 - protein, 21 aa, Artificial Sequence
  Description of Artificial Sequence: Synthetic peptide
GAMEPDYHRSFYQWFAAALGE

SEQ ID NO: 571 - protein, 21 aa, Artificial Sequence
  Description of Artificial Sequence: Synthetic peptide
CPDRQSVDDRFYNWFADALAS

SEQ ID NO: 572 - protein, 21 aa, Artificial Sequence
  Description of Artificial Sequence: Synthetic peptide
GGAQISFHERFYQWFLQEAAG

SEQ ID NO: 573 - protein, 21 aa, Artificial Sequence
  Description of Artificial Sequence: Synthetic peptide
HKRGIVQHGAFYAWFDSLLSG

SEQ ID NO: 574 - protein, 21 aa, Artificial Sequence
  Description of Artificial Sequence: Synthetic peptide
QASDNRSDGQFYLWFEKLLSS

SEQ ID NO: 575 - protein, 21 aa, Artificial Sequence
  Description of Artificial Sequence: Synthetic peptide
DRGRMGVDEGFYNWFARQMQE

SEQ ID NO: 576 - protein, 21 aa, Artificial Sequence
  Description of Artificial Sequence: Synthetic peptide
VTFTSAVFHENFYDWFVRQVS

SEQ ID NO: 577 - protein, 21 aa, Artificial Sequence
  Description of Artificial Sequence: Synthetic peptide
TASQECFDDGFYGWFRAWRCT

SEQ ID NO: 578 - protein, 21 aa, Artificial Sequence
  Description of Artificial Sequence: Synthetic peptide
SLDWRWSEEPFYRWFQRALAG

SEQ ID NO: 579 - protein, 21 aa, Artificial Sequence
  Description of Artificial Sequence: Synthetic peptide
CMSLSDCHRKFYGWFKSQGGE

SEQ ID NO: 580 - protein, 21 aa, Artificial Sequence
  Description of Artificial Sequence: Synthetic peptide
LALCRRSPGSFYGWFQAAVGC

SEQ ID NO: 581 - protein, 21 aa, Artificial Sequence
  Description of Artificial Sequence: Synthetic peptide
PRSATMSDGGFYWWFASQLGL

SEQ ID NO: 582 - protein, 21 aa, Artificial Sequence
  Description of Artificial Sequence: Synthetic peptide
  MOD_RES (14): Unknown amino acid; translation read-through at TGA stop codon
LRRSSVFHDPFYEXISRLVGG

SEQ ID NO: 583 - protein, 21 aa, Artificial Sequence
  Description of Artificial Sequence: Synthetic peptide
ARLQQQFHGGFYEWFRAQVSP

SEQ ID NO: 584 - protein, 21 aa, Artificial Sequence
  Description of Artificial Sequence: Synthetic peptide
AQLDNLCHEPFYSWFCAVTRE

SEQ ID NO: 585 - protein, 21 aa, Artificial Sequence
  Description of Artificial Sequence: Synthetic peptide
WTCDTAFHQDFYQWFCDKLGV

SEQ ID NO: 586 - protein, 21 aa, Artificial Sequence
  Description of Artificial Sequence: Synthetic peptide
GKEGFGLDRDFYWWFREQLGP

SEQ ID NO: 587 - protein, 21 aa, Artificial Sequence
  Description of Artificial Sequence: Synthetic peptide
GRAPSSFDCDFYCWFRNQVQS

SEQ ID NO: 588 - protein, 21 aa, Artificial Sequence
  Description of Artificial Sequence: Synthetic peptide
DVEAETQHRLFYAWFLSQLGS

SEQ ID NO: 589 - protein, 21 aa, Artificial Sequence
  Description of Artificial Sequence: Synthetic peptide
ISVTAVFHDGFYGWFNEQVSK

SEQ ID NO: 590 - protein, 21 aa, Artificial Sequence
  Description of Artificial Sequence: Synthetic peptide
NSEHGRLDVDFYGWFARVIQQ

SEQ ID NO: 591 - protein, 21 aa, Artificial Sequence
  Description of Artificial Sequence: Synthetic peptide
GPLGDGCQDGFYGWFMCQVST

SEQ ID NO: 592 - protein, 21 aa, Artificial Sequence
  Description of Artificial Sequence: Synthetic peptide
KRSAYNFHDPFYDWFRMQLSG

SEQ ID NO: 593 - protein, 21 aa, Artificial Sequence
  Description of Artificial Sequence: Synthetic peptide
ASEPGGYLDPFYGWFREQLRA

SEQ ID NO: 594 - protein, 21 aa, Artificial Sequence
  Description of Artificial Sequence: Synthetic peptide
NRGDGGVHSGFYNWFRLQLSG

SEQ ID NO: 595 - protein, 21 aa, Artificial Sequence
  Description of Artificial Sequence: Synthetic peptide
ASKGSSLHNDFYGWFAQQLAR

SEQ ID NO: 596 - protein, 21 aa, Artificial Sequence
  Description of Artificial Sequence: Synthetic peptide
ANVSMWIQVGFYDWFDAQLRQ

SEQ ID NO: 597 - protein, 21 aa, Artificial Sequence
  Description of Artificial Sequence: Synthetic peptide
RTSPGSLHDPFYDWFQQQLGG

SEQ ID NO: 598 - protein, 21 aa, Artificial Sequence
  Description of Artificial Sequence: Synthetic peptide
PGVMSSFHGGFYSWFREQLNG

SEQ ID NO: 599 - protein, 21 aa, Artificial Sequence
  Description of Artificial Sequence: Synthetic peptide
CLANSEDHDSFYGWFCQALGG

SEQ ID NO: 600 - protein, 21 aa, Artificial Sequence
  Description of Artificial Sequence: Synthetic peptide
GGSMGGMHGSFYEWFALQLRS

SEQ ID NO: 601 - protein, 21 aa, Artificial Sequence
  Description of Artificial Sequence: Synthetic peptide
RPQGGSIHAGFYQWFRDAVAG

SEQ ID NO: 602 - protein, 21 aa, Artificial Sequence
  Description of Artificial Sequence: Synthetic peptide
GALSSLFDAAFYDWFNRQLEG

SEQ ID NO: 603 - protein, 21 aa, Artificial Sequence
  Description of Artificial Sequence: Synthetic peptide
KVDLRGFHDGFYGWFARQLAG

SEQ ID NO: 604 - protein, 21 aa, Artificial Sequence
  Description of Artificial Sequence: Synthetic peptide
CSGLQRCHDSFYSWFESVVRE

SEQ ID NO: 605 - protein, 21 aa, Artificial Sequence
  Description of Artificial Sequence: Synthetic peptide
DSLGISFHEGFYDWFRRQLDM

SEQ ID NO: 606 - protein, 18 aa, Artificial Sequence
  Description of Artificial Sequence: Synthetic peptide
SGVFNGTFYDWFRIQLGE

SEQ ID NO: 607 - protein, 21 aa, Artificial Sequence
  Description of Artificial Sequence: Synthetic peptide
GYREMRSDLGFYQWFRDQLGL

SEQ ID NO: 608 - protein, 21 aa, Artificial Sequence
  Description of Artificial Sequence: Synthetic peptide
SVFMQHDHVGFYAWFRSLMEE

SEQ ID NO: 609 - protein, 21 aa, Artificial Sequence
  Description of Artificial Sequence: Synthetic peptide
FRHITEVDRSFYGWFVEQLRG

SEQ ID NO: 610 - protein, 21 aa, Artificial Sequence
  Description of Artificial Sequence: Synthetic peptide
WAGGSDVDGSFYDWFQRLLAS

SEQ ID NO: 611 - protein, 21 aa, Artificial Sequence
  Description of Artificial Sequence: Synthetic peptide
GLQNVSFHSGFYEWFARQVSQ

SEQ ID NO: 612 - protein, 21 aa, Artificial Sequence
  Description of Artificial Sequence: Synthetic peptide
SRVSDPYHVGFYQWFEEVVRG

SEQ ID NO: 613 - protein, 21 aa, Artificial Sequence
  Description of Artificial Sequence: Synthetic peptide
MGGATFFHTGFYDWFAAQLQH

SEQ ID NO: 614 - protein, 21 aa, Artificial Sequence
  Description of Artificial Sequence: Synthetic peptide
RPASRPFHSGFYQWFADQLSH

SEQ ID NO: 615 - protein, 21 aa, Artificial Sequence
  Description of Artificial Sequence: Synthetic peptide
GLAPGNFHEDFYRWFQEQTLG

SEQ ID NO: 616 - protein, 21 aa, Artificial Sequence
  Description of Artificial Sequence: Synthetic peptide
TAAISDFNSLFYGWFEQLLSS

SEQ ID NO: 617 - protein, 21 aa, Artificial Sequence
  Description of Artificial Sequence: Synthetic peptide
LDEDLPQHAGFYGWFAEALGV

SEQ ID NO: 618 - protein, 21 aa, Artificial Sequence
  Description of Artificial Sequence: Synthetic peptide
ASHKSAFDDNFYRWFSMQLRD

SEQ ID NO: 619 - protein, 21 aa, Artificial Sequence
  Description of Artificial Sequence: Synthetic peptide
HTGAGDLHGAFYNWFLEQLGG

SEQ ID NO: 620 - protein, 21 aa, Artificial Sequence
  Description of Artificial Sequence: Synthetic peptide
RRGRDGFHGGFYDWFAAQLSD

SEQ ID NO: 621 - protein, 21 aa, Artificial Sequence
  Description of Artificial Sequence: Synthetic peptide
GNFREAFHADFYSWFERQLQS

SEQ ID NO: 622 - protein, 21 aa, Artificial Sequence
  Description of Artificial Sequence: Synthetic peptide
RDTLPAFHQHFYQWFEKQVSA

SEQ ID NO: 623 - protein, 21 aa, Artificial Sequence
  Description of Artificial Sequence: Synthetic peptide
ERETAAFGQAFYQWFRDQIAG

SEQ ID NO: 624 - protein, 21 aa, Artificial Sequence
  Description of Artificial Sequence: Synthetic peptide
WGEGGGFYDWFYDQLGWEPSH

SEQ ID NO: 625 - protein, 21 aa, Artificial Sequence
  Description of Artificial Sequence: Synthetic peptide
SLVAADLHEGFYGWFRSQLGG

SEQ ID NO: 626 - protein, 21 aa, Artificial Sequence
  Description of Artificial Sequence: Synthetic peptide
TSEVGDFHAEFYSWFEIQLGR

SEQ ID NO: 627 - protein, 21 aa, Artificial Sequence
  Description of Artificial Sequence: Synthetic peptide
TGADGLLHARFYAWFEEQLRE

SEQ ID NO: 628 - protein, 21 aa, Artificial Sequence
  Description of Artificial Sequence: Synthetic peptide
RRSDSSLHRSFYDWFSVQLLN

SEQ ID NO: 629 - protein, 21 aa, Artificial Sequence
  Description of Artificial Sequence: Synthetic peptide
SESKYLLHSGFYGWFEAQLRG

SEQ ID NO: 630 - protein, 21 aa, Artificial Sequence
  Description of Artificial Sequence: Synthetic peptide
HGVIRADHTGFYGWFSKQLSD

SEQ ID NO: 631 - protein, 21 aa, Artificial Sequence
  Description of Artificial Sequence: Synthetic peptide
  MOD_RES (5): Unknown amino acid
LINAXVFRRGFYAWFEEQVSK

SEQ ID NO: 632 - protein, 21 aa, Artificial Sequence
  Description of Artificial Sequence: Synthetic peptide
LQRYIGFHDPFYDWFSRALSG

SEQ ID NO: 633 - protein, 21 aa, Artificial Sequence
  Description of Artificial Sequence: Synthetic peptide
MRTAELFHVGFYDWFDAQLMD

SEQ ID NO: 634 - protein, 21 aa, Artificial Sequence
  Description of Artificial Sequence: Synthetic peptide
WAPPDALHGQFYRWFQRQLDQ

SEQ ID NO: 635 - protein, 21 aa, Artificial Sequence
  Description of Artificial Sequence: Synthetic peptide
AVHAATFHDDFYRWFEQVVGS

SEQ ID NO: 636 - protein, 21 aa, Artificial Sequence
  Description of Artificial Sequence: Synthetic peptide
FDAVHGFDGGFYGWFKRELQR

SEQ ID NO: 637 - protein, 21 aa, Artificial Sequence
  Description of Artificial Sequence: Synthetic peptide
QAGGMEFHGAFYNWFLQQLSG

SEQ ID NO: 638 - protein, 21 aa, Artificial Sequence
  Description of Artificial Sequence: Synthetic peptide
GRSVSRMNAEFYQWFGHQLAA

SEQ ID NO: 639 - protein, 21 aa, Artificial Sequence
  Description of Artificial Sequence: Synthetic peptide
AAVNSLFHDEFYLWFQDQLDG

SEQ ID NO: 640 - protein, 21 aa, Artificial Sequence
  Description of Artificial Sequence: Synthetic peptide
QLGMDWFHADFYEWFLAQLPS

SEQ ID NO: 641 - protein, 21 aa, Artificial Sequence
  Description of Artificial Sequence: Synthetic peptide
RLAGSGIHEGFYGWFVDQLLA

SEQ ID NO: 642 - protein, 21 aa, Artificial Sequence
  Description of Artificial Sequence: Synthetic peptide
GREIGGVHDGFYDWFRQQSEQ

SEQ ID NO: 643 - protein, 21 aa, Artificial Sequence
  Description of Artificial Sequence: Synthetic peptide
VRSEQRFDSSFYQWFNDLLMS

SEQ ID NO: 644 - protein, 21 aa, Artificial Sequence
  Description of Artificial Sequence: Synthetic peptide
QSPYGFFHDGFYRWFLQQTGM

SEQ ID NO: 645 - protein, 21 aa, Artificial Sequence
  Description of Artificial Sequence: Synthetic peptide
FQCGAAFHVDFYRWFTCQEQF

SEQ ID NO: 646 - protein, 21 aa, Artificial Sequence
  Description of Artificial Sequence: Synthetic peptide
GAFGSEFHEQFYRWFEDALSF

SEQ ID NO: 647 - protein, 21 aa, Artificial Sequence
  Description of Artificial Sequence: Synthetic peptide
EHTSYQIHRQFYEWFDRALGR

SEQ ID NO: 648 - protein, 21 aa, Artificial Sequence
  Description of Artificial Sequence: Synthetic peptide
SGTAADLHSRFYGWFALQARE

SEQ ID NO: 649 - protein, 21 aa, Artificial Sequence
  Description of Artificial Sequence: Synthetic peptide
EGFGVLFHGQFYRWFQLQLDG

SEQ ID NO: 650 - protein, 21 aa, Artificial Sequence
  Description of Artificial Sequence: Synthetic peptide
QQSAGHPHSSFYLWFSELLGA

SEQ ID NO: 651 - protein, 21 aa, Artificial Sequence
  Description of Artificial Sequence: Synthetic peptide
YLQRAGFHRSFYGWFDQALRD

SEQ ID NO: 652 - protein, 21 aa, Artificial Sequence
  Description of Artificial Sequence: Synthetic peptide
MWLWATLHSDFYSWFEQVVSG

SEQ ID NO: 653 - protein, 21 aa, Artificial Sequence
  Description of Artificial Sequence: Synthetic peptide
GANALGFKDRFYEWFAAQLWD

SEQ ID NO: 654 - protein, 21 aa, Artificial Sequence
  Description of Artificial Sequence: Synthetic peptide
GSGLYVFHWGFYDWFEQQMGG

SEQ ID NO: 655 - protein, 21 aa, Artificial Sequence
  Description of Artificial Sequence: Synthetic peptide
LDKGWGFDLQFYRWFEAATRA

SEQ ID NO: 656 - protein, 21 aa, Artificial Sequence
  Description of Artificial Sequence: Synthetic peptide
QRSAVEFHADFYDWFLRLLTP

SEQ ID NO: 657 - protein, 21 aa, Artificial Sequence
  Description of Artificial Sequence: Synthetic peptide
DQRMGSFHGEFYRWFEETLLS

SEQ ID NO: 658 - protein, 21 aa, Artificial Sequence
  Description of Artificial Sequence: Synthetic peptide
GRFYGWFQDAIDQLMPWGFDP

SEQ ID NO: 659 - protein, 21 aa, Artificial Sequence
  Description of Artificial Sequence: Synthetic peptide
IQGWEPFYGWFDDVVAQMFEE

SEQ ID NO: 660 - protein, 17 aa, Artificial Sequence
  Description of Artificial Sequence: Synthetic peptide
RYGRWGLAQQFYDWFDR

SEQ ID NO: 661 - protein, 17 aa, Artificial Sequence
  Description of Artificial Sequence: Synthetic peptide
RGRLGSLSTQFYNWFAE

SEQ ID NO: 662 - protein, 21 aa, Artificial Sequence
  Description of Artificial Sequence: Synthetic peptide
ASAYTPFYQWFADVVSEYMQQ

SEQ ID NO: 663 - protein, 21 aa, Artificial Sequence
  Description of Artificial Sequence: Synthetic peptide
PYRMEGTEKWNFYDWFVAQLQ

SEQ ID NO: 664 - protein, 21 aa, Artificial Sequence
  Description of Artificial Sequence: Synthetic peptide
SAVHFQFYKWFDNLLPVPLSA

SEQ ID NO: 665 - protein, 21 aa, Artificial Sequence
  Description of Artificial Sequence: Synthetic peptide
VPVNKSFYRWFQLVLGGSDDW

SEQ ID NO: 666 - protein, 21 aa, Artificial Sequence
  Description of Artificial Sequence: Synthetic peptide
QSPRASFYGWFDDVLRAAGVV

SEQ ID NO: 667 - protein, 21 aa, Artificial Sequence
  Description of Artificial Sequence: Synthetic peptide
TGFYEWFYEQLHSRMLPNPLD

SEQ ID NO: 668 - protein, 21 aa, Artificial Sequence
  Description of Artificial Sequence: Synthetic peptide
RRGVGGFYGWFSQQLQGMGVA

SEQ ID NO: 669 - protein, 21 aa, Artificial Sequence
  Description of Artificial Sequence: Synthetic peptide
SSQDRRFYRWFEQAIVGGRDG

SEQ ID NO: 670 - protein, 21 aa, Artificial Sequence
  Description of Artificial Sequence: Synthetic peptide
TRGQLGFYNWFQQALSTSGMG

SEQ ID NO: 671 - protein, 21 aa, Artificial Sequence
  Description of Artificial Sequence: Synthetic peptide
CADLNAFYQWFCGVLDRGSDH

SEQ ID NO: 672 - protein, 21 aa, Artificial Sequence
  Description of Artificial Sequence: Synthetic peptide
TLIQDQFYWWFSDLLSAEPGD

SEQ ID NO: 673 - protein, 21 aa, Artificial Sequence
  Description of Artificial Sequence: Synthetic peptide
IDQLDAFYRWFDGVMLGMGDP

SEQ ID NO: 674 - protein, 20 aa, Artificial Sequence
  Description of Artificial Sequence: Synthetic peptide
RGGGTFYEWFESALRKHGAG

SEQ ID NO: 675 - protein, 21 aa, Artificial Sequence
  Description of Artificial Sequence: Synthetic peptide
RGLDQDFYRWFQNLVGVEYDR

SEQ ID NO: 676 - protein, 21 aa, Artificial Sequence
  Description of Artificial Sequence: Synthetic peptide
MQGHRGFYGWFARVLEQDRGW

SEQ ID NO: 677 - protein, 21 aa, Artificial Sequence
  Description of Artificial Sequence: Synthetic peptide
ERLHLRFYEWFDTVIGQDGSD

SEQ ID NO: 678 - protein, 21 aa, Artificial Sequence
  Description of Artificial Sequence: Synthetic peptide
MHVQSDFYHWFQSLLGQGGPD

SEQ ID NO: 679 - protein, 21 aa, Artificial Sequence
  Description of Artificial Sequence: Synthetic peptide
TMGTQGFYRWFQNVVKEHLSG

SEQ ID NO: 680 - protein, 21 aa, Artificial Sequence
  Description of Artificial Sequence: Synthetic peptide
ITHNRGFYSWFLDVVQGGAGA

SEQ ID NO: 681 - protein, 21 aa, Artificial Sequence
  Description of Artificial Sequence: Synthetic peptide
VRRDAGFYQWFADILTQLDFE

SEQ ID NO: 682 - protein, 21 aa, Artificial Sequence
  Description of Artificial Sequence: Synthetic peptide
MQLQDEFYNWFRGIMLNDGQD

SEQ ID NO: 683 - protein, 21 aa, Artificial Sequence
  Description of Artificial Sequence: Synthetic peptide
GIRSSGFYQWFDRVLAGVGDG

SEQ ID NO: 684 - protein, 21 aa, Artificial Sequence
  Description of Artificial Sequence: Synthetic peptide
ANLNSQFYSWFASVTGEASPS

SEQ ID NO: 685 - protein, 21 aa, Artificial Sequence
  Description of Artificial Sequence: Synthetic peptide
QSPRASFYGWFDDVLRAAGVV

SEQ ID NO: 686 - protein, 21 aa, Artificial Sequence
  Description of Artificial Sequence: Synthetic peptide
MQRNQGFYSWFDDLVSSTVGV

SEQ ID NO: 687 - protein, 21 aa, Artificial Sequence
  Description of Artificial Sequence: Synthetic peptide
ASGFDPFYAWFLEQLRVANGS

SEQ ID NO: 688 - protein, 21 aa, Artificial Sequence
  Description of Artificial Sequence: Synthetic peptide
SGTPYGFYRWFQSALASATSG

SEQ ID NO: 689 - protein, 21 aa, Artificial Sequence
  Description of Artificial Sequence: Synthetic peptide
QGVEGGFYEWFDRAMGDVRPW

SEQ ID NO: 690 - protein, 21 aa, Artificial Sequence
  Description of Artificial Sequence: Synthetic peptide
DNMSGGFYRWFAQVVADSGGD

SEQ ID NO: 691 - protein, 21 aa, Artificial Sequence
  Description of Artificial Sequence: Synthetic peptide
RGTDDTFYGWFDQLLQGWCDD

SEQ ID NO: 692 - protein, 21 aa, Artificial Sequence
  Description of Artificial Sequence: Synthetic peptide
TVDHTQFYDWFSRVLGESGSA

SEQ ID NO: 693 - protein, 21 aa, Artificial Sequence
  Description of Artificial Sequence: Synthetic peptide
GRQDREFYYWFELQAGGMDGD

SEQ ID NO: 694 - protein, 21 aa, Artificial Sequence
  Description of Artificial Sequence: Synthetic peptide
RLLLGGFYEWFDQVLKETKEV

SEQ ID NO: 695 - protein, 21 aa, Artificial Sequence
  Description of Artificial Sequence: Synthetic peptide
GVLSTGFYEWFALQLHGLAAG

SEQ ID NO: 696 - protein, 21 aa, Artificial Sequence
  Description of Artificial Sequence: Synthetic peptide
PAVGQSFYGWFEAVLRGSKAG

SEQ ID NO: 697 - protein, 21 aa, Artificial Sequence
  Description of Artificial Sequence: Synthetic peptide
SNGISGFYEWFAAQVQTSDFQ

SEQ ID NO: 698 - protein, 21 aa, Artificial Sequence
  Description of Artificial Sequence: Synthetic peptide
LLGLSQAAYANFYDWFVSQLA

SEQ ID NO: 699 - protein, 21 aa, Artificial Sequence
  Description of Artificial Sequence: Synthetic peptide
VPNSWMFYNWFAEQIEGSEGE

SEQ ID NO: 700 - protein, 21 aa, Artificial Sequence
  Description of Artificial Sequence: Synthetic peptide
ARRADGFYDWFREQVSGSAVQ

SEQ ID NO: 701 - protein, 21 aa, Artificial Sequence
  Description of Artificial Sequence: Synthetic peptide
GVVEGTFYEWFDRLLGGVQGD

SEQ ID NO: 702 - protein, 21 aa, Artificial Sequence
  Description of Artificial Sequence: Synthetic peptide
SHLTDPFYQWFVDQLRAGVRG

SEQ ID NO: 703 - protein, 21 aa, Artificial Sequence
  Description of Artificial Sequence: Synthetic peptide
RSNDDAFYRWFSNILQVDGGG

SEQ ID NO: 704 - protein, 21 aa, Artificial Sequence
  Description of Artificial Sequence: Synthetic peptide
DSDGAQFYIWFEDQLRSAGWD

SEQ ID NO: 705 - protein, 21 aa, Artificial Sequence
  Description of Artificial Sequence: Synthetic peptide
PGLHRAFYQWFAEAVRSANKE

SEQ ID NO: 706 - protein, 20 aa, Artificial Sequence
  Description of Artificial Sequence: Synthetic peptide
SLGQGGFYDWFASQVGGADI

SEQ ID NO: 707 - protein, 21 aa, Artificial Sequence
  Description of Artificial Sequence: Synthetic peptide
CGQTQSFYQWFCEVMRVESGD

SEQ ID NO: 708 - protein, 21 aa, Artificial Sequence
  Description of Artificial Sequence: Synthetic peptide
IVVPGDTQGVNFYDWFVKQLQ

SEQ ID NO: 709 - protein, 21 aa, Artificial Sequence
  Description of Artificial Sequence: Synthetic peptide
RDVSMGSASTNFYDWFVQQLG

SEQ ID NO: 710 - protein, 21 aa, Artificial Sequence
  Description of Artificial Sequence: Synthetic peptide
SQAGSAFYAWFDQVLRTVHSA

SEQ ID NO: 711 - protein, 21 aa, Artificial Sequence
  Description of Artificial Sequence: Synthetic peptide
SNGISGFYEWFAAQVQTSDFQ

SEQ ID NO: 712 - protein, 17 aa, Artificial Sequence
  Description of Artificial Sequence: Synthetic peptide
RRDRGGLDVFFYQWFMD

SEQ ID NO: 713 - protein, 20 aa, Artificial Sequence
  Description of Artificial Sequence: Synthetic peptide
HLCVLEELFWGASLFGYCSG

SEQ ID NO: 714 - protein, 20 aa, Artificial Sequence
  Description of Artificial Sequence: Synthetic peptide
PLCVLEELFWSTPLFGQCSY

SEQ ID NO: 715 - protein, 20 aa, Artificial Sequence
  Description of Artificial Sequence: Synthetic peptide
HLCVLEELFWGASLFAQCVG

SEQ ID NO: 716 - protein, 20 aa, Artificial Sequence
  Description of Artificial Sequence: Synthetic peptide
DLCVLEELFWGASRFGQCSG

SEQ ID NO: 717 - protein, 20 aa, Artificial Sequence
  Description of Artificial Sequence: Synthetic peptide
HLCVLEELFWGASLFGQCAG

SEQ ID NO: 718 - protein, 20 aa, Artificial Sequence
  Description of Artificial Sequence: Synthetic peptide
HLCVVEELFWGASLFGQCSG

SEQ ID NO: 719 - protein, 20 aa, Artificial Sequence
  Description of Artificial Sequence: Synthetic peptide
NLCDLEVLFWGASLFRQCSG

SEQ ID NO: 720 - protein, 20 aa, Artificial Sequence
  Description of Artificial Sequence: Synthetic peptide
PLCVLEEQFWGASLFGQCSG

SEQ ID NO: 721 - protein, 20 aa, Artificial Sequence
  Description of Artificial Sequence: Synthetic peptide
QLCVLEELFWGASEFGQCSG

SEQ ID NO: 722 - protein, 20 aa, Artificial Sequence
  Description of Artificial Sequence: Synthetic peptide
HLCELEELFWGASLFGQCSG

SEQ ID NO: 723 - protein, 20 aa, Artificial Sequence
  Description of Artificial Sequence: Synthetic peptide
PLCVLEELFWGESLFGQCSG

SEQ ID NO: 724 - protein, 20 aa, Artificial Sequence
  Description of Artificial Sequence: Synthetic peptide
HLCVLEELFWGASRFGQCSG

SEQ ID NO: 725 - protein, 20 aa, Artificial Sequence
  Description of Artificial Sequence: Synthetic peptide
KLCVLEELFWGASLFGQCSG

SEQ ID NO: 726 - protein, 20 aa, Artificial Sequence
  Description of Artificial Sequence: Synthetic peptide
YLCVLEELSWGASLFGQCSG

SEQ ID NO: 727 - protein, 20 aa, Artificial Sequence
  Description of Artificial Sequence: Synthetic peptide
HLCVLEELLWGASLFAQCSG

SEQ ID NO: 728 - protein, 20 aa, Artificial Sequence
  Description of Artificial Sequence: Synthetic peptide
QLCVLEQLFWGESLFGQCSG

SEQ ID NO: 729 - protein, 20 aa, Artificial Sequence
  Description of Artificial Sequence: Synthetic peptide
HLCVLEELFWGGNLFSQCSG

SEQ ID NO: 730 - protein, 20 aa, Artificial Sequence
  Description of Artificial Sequence: Synthetic peptide
HLCVLEELFWGASLYGQCSG

SEQ ID NO: 731 - protein, 20 aa, Artificial Sequence
  Description of Artificial Sequence: Synthetic peptide
SLCALEEQFWGAALFGYCSG

SEQ ID NO: 732 - protein, 20 aa, Artificial Sequence
  Description of Artificial Sequence: Synthetic peptide
HLCVLEEQFWGASLFDGCAG

SEQ ID NO: 733 - protein, 20 aa, Artificial Sequence
  Description of Artificial Sequence: Synthetic peptide
QLCVLEELFWGASLFGQCSG

SEQ ID NO: 734 - protein, 20 aa, Artificial Sequence
  Description of Artificial Sequence: Synthetic peptide
PLCVLEELFWGAALFGQCSG

SEQ ID NO: 735 - protein, 20 aa, Artificial Sequence
  Description of Artificial Sequence: Synthetic peptide
HLCVLEELFWGASLFGQCTG

SEQ ID NO: 736 - protein, 20 aa, Artificial Sequence
  Description of Artificial Sequence: Synthetic peptide
PLCVLEELFWGGSLFGQCSG

SEQ ID NO: 737 - protein, 20 aa, Artificial Sequence
  Description of Artificial Sequence: Synthetic peptide
QLCVLEELVWGASLFGQCSG

SEQ ID NO: 738 - protein, 20 aa, Artificial Sequence
  Description of Artificial Sequence: Synthetic peptide
HLCVVEELIWGASLFGQCSR

SEQ ID NO: 739 - protein, 20 aa, Artificial Sequence
  Description of Artificial Sequence: Synthetic peptide
DLCVLEELFWGASLFGQCAG

SEQ ID NO: 740 - protein, 20 aa, Artificial Sequence
  Description of Artificial Sequence: Synthetic peptide
QLCVLEERFWGASLFGQCSG

SEQ ID NO: 741 - protein, 20 aa, Artificial Sequence
  Description of Artificial Sequence: Synthetic peptide
NLCVLEELFWGAALFGQCSG

SEQ ID NO: 742 - protein, 20 aa, Artificial Sequence
  Description of Artificial Sequence: Synthetic peptide
QLCVLEELFWGSSLFGQCSG

SEQ ID NO: 743 - protein, 20 aa, Artificial Sequence
  Description of Artificial Sequence: Synthetic peptide
DLCVVEELFWGKSLFGQCSG

SEQ ID NO: 744 - protein, 20 aa, Artificial Sequence
  Description of Artificial Sequence: Synthetic peptide
DLCVLEELFWGSSLFGQCSG

SEQ ID NO: 745 - protein, 20 aa, Artificial Sequence
  Description of Artificial Sequence: Synthetic peptide
YLCVLEEQFWGASLFRQCFG

SEQ ID NO: 746 - protein, 20 aa, Artificial Sequence
  Description of Artificial Sequence: Synthetic peptide
HLCVLEELLWGSSLFGQCSG

SEQ ID NO: 747 - protein, 20 aa, Artificial Sequence
  Description of Artificial Sequence: Synthetic peptide
PLCGLEELFWGASLFGQCSD

SEQ ID NO: 748 - protein, 20 aa, Artificial Sequence
  Description of Artificial Sequence: Synthetic peptide
HLCVLEELFWGSSLFAQCSG

SEQ ID NO: 749 - protein, 20 aa, Artificial Sequence
  Description of Artificial Sequence: Synthetic peptide
PLCAIEELFWGAALFGQCSG

SEQ ID NO: 750 - protein, 20 aa, Artificial Sequence
  Description of Artificial Sequence: Synthetic peptide
HLCVLEEQFWGASLFGDCSG

SEQ ID NO: 751 - protein, 20 aa, Artificial Sequence
  Description of Artificial Sequence: Synthetic peptide
PLCVLEELFWGAPLFGQCSD

SEQ ID NO: 752 - protein, 20 aa, Artificial Sequence
  Description of Artificial Sequence: Synthetic peptide
DLCGLEELFWGAALFGQCTS

SEQ ID NO: 753 - protein, 20 aa, Artificial Sequence
  Description of Artificial Sequence: Synthetic peptide
QLCVLEKQLWGASLFWQCSG

SEQ ID NO: 754 - protein, 20 aa, Artificial Sequence
  Description of Artificial Sequence: Synthetic peptide
HLCVLEELFWGASLYGQCPG

SEQ ID NO: 755 - protein, 20 aa, Artificial Sequence
  Description of Artificial Sequence: Synthetic peptide
HLCVLEELFWGASLFDQCSG

SEQ ID NO: 756 - protein, 20 aa, Artificial Sequence
  Description of Artificial Sequence: Synthetic peptide
HLCVLEELLWGASLFGQCSG

SEQ ID NO: 757 - protein, 20 aa, Artificial Sequence
  Description of Artificial Sequence: Synthetic peptide
PLCVLEELFWGVSLFGQCGG

SEQ ID NO: 758 - protein, 20 aa, Artificial Sequence
  Description of Artificial Sequence: Synthetic peptide
HLCVLEELFWGASQWGQCSG

SEQ ID NO: 759 - protein, 20 aa, Artificial Sequence
  Description of Artificial Sequence: Synthetic peptide
RLCVLEEQFWGGALFGQCSG

SEQ ID NO: 760 - protein, 20 aa, Artificial Sequence
  Description of Artificial Sequence: Synthetic peptide
QLCVLEELFWGVSLFAQCSG

SEQ ID NO: 761 - protein, 20 aa, Artificial Sequence
  Description of Artificial Sequence: Synthetic peptide
HLCVLEELFWGAALFGQCFG

SEQ ID NO: 762 - protein, 20 aa, Artificial Sequence
  Description of Artificial Sequence: Synthetic peptide
YLCVLEELFWGASQFGQCSG

SEQ ID NO: 763 - protein, 20 aa, Artificial Sequence
  Description of Artificial Sequence: Synthetic peptide
HLCVLEELYWGASLFGQCSG

SEQ ID NO: 764 - protein, 20 aa, Artificial Sequence
  Description of Artificial Sequence: Synthetic peptide
HLCVLEERFWGVSLFGQCSG

SEQ ID NO: 765 - protein, 20 aa, Artificial Sequence
  Description of Artificial Sequence: Synthetic peptide
PLCVLEELFWGASRFGQCSG

SEQ ID NO: 766 - protein, 20 aa, Artificial Sequence
  Description of Artificial Sequence: Synthetic peptide
HLCVLEDLFWGASLFDQCSG

SEQ ID NO: 767 - protein, 20 aa, Artificial Sequence
  Description of Artificial Sequence: Synthetic peptide
HLCDLEVLFWGASLFGQCSG

SEQ ID NO: 768 - protein, 20 aa, Artificial Sequence
  Description of Artificial Sequence: Synthetic peptide
QLCILEEQFWGTSLFGYCSG

SEQ ID NO: 769 - protein, 20 aa, Artificial Sequence
  Description of Artificial Sequence: Synthetic peptide
ALCVLEELFWGESLFGQCSG

SEQ ID NO: 770 - protein, 20 aa, Artificial Sequence
  Description of Artificial Sequence: Synthetic peptide
RLCVLEERFWGAALFGQCSG

SEQ ID NO: 771 - protein, 20 aa, Artificial Sequence
  Description of Artificial Sequence: Synthetic peptide
PLCVLEELFWGASLFGQCSG

SEQ ID NO: 772 - protein, 20 aa, Artificial Sequence
  Description of Artificial Sequence: Synthetic peptide
SLCVLEELFWGGSRFGQCSG

SEQ ID NO: 773 - protein, 20 aa, Artificial Sequence
  Description of Artificial Sequence: Synthetic peptide
HLCLLEEQFWGASLFGYCFE

SEQ ID NO: 774 - protein, 20 aa, Artificial Sequence
  Description of Artificial Sequence: Synthetic peptide
HLCVLEEQFWGASLFGQCSG

SEQ ID NO: 775 - protein, 20 aa, Artificial Sequence
  Description of Artificial Sequence: Synthetic peptide
DLCLLEELLWGASRFGQCSG

SEQ ID NO: 776 - protein, 20 aa, Artificial Sequence
  Description of Artificial Sequence: Synthetic peptide
YLCVLEERFWGASLFGQCSG

SEQ ID NO: 777 - protein, 20 aa, Artificial Sequence
  Description of Artificial Sequence: Synthetic peptide
HLCVLEEQFWGASLFGSCSG

SEQ ID NO: 778 - protein, 20 aa, Artificial Sequence
  Description of Artificial Sequence: Synthetic peptide
QLCVLEEQLWGASLFGQCSG

SEQ ID NO: 779 - protein, 20 aa, Artificial Sequence
  Description of Artificial Sequence: Synthetic peptide
  MOD_RES (10): Unknown amino acid; translation read-through at TGA stop codon
HLCVLEELFXGESLFGYCSG

SEQ ID NO: 780 - protein, 20 aa, Artificial Sequence
  Description of Artificial Sequence: Synthetic peptide
HLCVLEELFWGASLFGQCSG

SEQ ID NO: 781 - protein, 20 aa, Artificial Sequence
  Description of Artificial Sequence: Synthetic peptide
PLCVLEELFWGASHFGQCSG

SEQ ID NO: 782 - protein, 20 aa, Artificial Sequence
  Description of Artificial Sequence: Synthetic peptide
HLCVLEELVWGASLFGQCAG

SEQ ID NO: 783 - protein, 20 aa, Artificial Sequence
  Description of Artificial Sequence: Synthetic peptide
QLCVLEELIWGASLFGQCAG

SEQ ID NO: 784 - protein, 20 aa, Artificial Sequence
  Description of Artificial Sequence: Synthetic peptide
HLCGLEELFWGASLFGQCSG

SEQ ID NO: 785 - protein, 20 aa, Artificial Sequence
  Description of Artificial Sequence: Synthetic peptide
HLCVLEELVWGESLFGQCSG

SEQ ID NO: 786 - protein, 20 aa, Artificial Sequence
  Description of Artificial Sequence: Synthetic peptide
RLCVLEELYWGASLFGQCSG

SEQ ID NO: 787 - protein, 20 aa, Artificial Sequence
  Description of Artificial Sequence: Synthetic peptide
RLCILEELFWGASLFGQCSG

SEQ ID NO: 788 - protein, 20 aa, Artificial Sequence
  Description of Artificial Sequence: Synthetic peptide
HLCVLEELFWGATLFDQCSG

SEQ ID NO: 789 - protein, 20 aa, Artificial Sequence
  Description of Artificial Sequence: Synthetic peptide
HLCFLEELFWGASMFGQCSG

SEQ ID NO: 790 - protein, 20 aa, Artificial Sequence
  Description of Artificial Sequence: Synthetic peptide
HLCIVEELFWAAPLFGQCSG

SEQ ID NO: 791 - protein, 20 aa, Artificial Sequence
  Description of Artificial Sequence: Synthetic peptide
HLCVLEELWWGASLFAQCSA

SEQ ID NO: 792 - protein, 20 aa, Artificial Sequence
  Description of Artificial Sequence: Synthetic peptide
NLCALEELFWGASQFRYCPG

SEQ ID NO: 793 - protein, 20 aa, Artificial Sequence
  Description of Artificial Sequence: Synthetic peptide
RLCVLEELFWGASLFGQCSG

SEQ ID NO: 794 - protein, 20 aa, Artificial Sequence
  Description of Artificial Sequence: Synthetic peptide
PLCVLEELFWGASLFGQCPG

SEQ ID NO: 795 - protein, 20 aa, Artificial Sequence
  Description of Artificial Sequence: Synthetic peptide
NLCVLEELFWGASLFGQCSG

SEQ ID NO: 796 - protein, 20 aa, Artificial Sequence
  Description of Artificial Sequence: Synthetic peptide
  MOD_RES (7): Unknown amino acid; translation read-through at TAA stop codon
QLCVLGXRFWGGSLCGYCSD

SEQ ID NO: 797 - protein, 20 aa, Artificial Sequence
  Description of Artificial Sequence: Synthetic peptide
PLCFLQELFGGASLGGYCSG

SEQ ID NO: 798 - protein, 20 aa, Artificial Sequence
  Description of Artificial Sequence: Synthetic peptide
FMCGLQELVGGAALLGHCSG

SEQ ID NO: 799 - protein, 20 aa, Artificial Sequence
  Description of Artificial Sequence: Synthetic peptide
PLCFLQELFGGGSLSGYCSG

SEQ ID NO: 800 - protein, 20 aa, Artificial Sequence
  Description of Artificial Sequence: Synthetic peptide
FLCGLEELAWGVSRSGYCFG

SEQ ID NO: 801 - protein, 20 aa, Artificial Sequence
  Description of Artificial Sequence: Synthetic peptide
PLCFLAELFSGSALGGDCSR

SEQ ID NO: 802 - protein, 20 aa, Artificial Sequence
  Description of Artificial Sequence: Synthetic peptide
PLCVLQELFGGGSLGGYCSG

SEQ ID NO: 803 - protein, 20 aa, Artificial Sequence
  Description of Artificial Sequence: Synthetic peptide
  MOD_RES (7): Unknown amino acid; translation read-through at TAA stop codon
QLCVLEXLFWGACLFGYCAG

SEQ ID NO: 804 - protein, 20 aa, Artificial Sequence
  Description of Artificial Sequence: Synthetic peptide
FLCGLQELSGVASLFGQCSG

SEQ ID NO: 805 - protein, 20 aa, Artificial Sequence
  Description of Artificial Sequence: Synthetic peptide
  MOD_RES (18): Unknown amino acid; translation read-through at TGA stop codon
RVCVLEQLVWGASLFGAXSG

SEQ ID NO: 806 - protein, 20 aa, Artificial Sequence
  Description of Artificial Sequence: Synthetic peptide
FYCGLEELSWGAALFGYCSG

SEQ ID NO: 807 - protein, 20 aa, Artificial Sequence
  Description of Artificial Sequence: Synthetic peptide
FLCGLEELSQGAVLFGHCYG

SEQ ID NO: 808 - protein, 20 aa, Artificial Sequence
  Description of Artificial Sequence: Synthetic peptide
HLCVLVGLFWDASLFGQCSG

SEQ ID NO: 809 - protein, 20 aa, Artificial Sequence
  Description of Artificial Sequence: Synthetic peptide
QRCIRAALFWCATLLGGCAG

SEQ ID NO: 810 - protein, 20 aa, Artificial Sequence
  Description of Artificial Sequence: Synthetic peptide
HQCIPDGMSQGAALRGNCSD

SEQ ID NO: 811 - protein, 20 aa, Artificial Sequence
  Description of Artificial Sequence: Synthetic peptide
HLCVLEDELWGVSLFGYCSS

SEQ ID NO: 812 - protein, 20 aa, Artificial Sequence
  Description of Artificial Sequence: Synthetic peptide
HLCMLEEQFWGASLFSRCSG

SEQ ID NO: 813 - protein, 20 aa, Artificial Sequence
  Description of Artificial Sequence: Synthetic peptide
TCAFWKNGSGVRRCSVTAVV

SEQ ID NO: 814 - protein, 20 aa, Artificial Sequence
  Description of Artificial Sequence: Synthetic peptide
  MOD_RES (8): Unknown amino acid
PLCGLKNXSGVRLCSSPALV

SEQ ID NO: 815 - protein, 20 aa, Artificial Sequence
  Description of Artificial Sequence: Synthetic peptide
PLCLQEELFWGASLFGYCSG

SEQ ID NO: 816 - protein, 20 aa, Artificial Sequence
  Description of Artificial Sequence: Synthetic peptide
PLCDLEELFWGASLFGDCPG

SEQ ID NO: 817 - protein, 20 aa, Artificial Sequence
  Description of Artificial Sequence: Synthetic peptide
DLCVLEELFWDGSLFASCSG

SEQ ID NO: 818 - protein, 20 aa, Artificial Sequence
  Description of Artificial Sequence: Synthetic peptide
PLCVLEEQLWGTALFGSCTG

SEQ ID NO: 819 - protein, 20 aa, Artificial Sequence
  Description of Artificial Sequence: Synthetic peptide
PLCLVEELLWGASLFSQCTG

SEQ ID NO: 820 - protein, 20 aa, Artificial Sequence
  Description of Artificial Sequence: Synthetic peptide
PLCDLEELYWGAALFGSCSG

SEQ ID NO: 821 - protein, 20 aa, Artificial Sequence
  Description of Artificial Sequence: Synthetic peptide
GLCFLEEQFWGTSLFRDCPG

SEQ ID NO: 822 - protein, 20 aa, Artificial Sequence
  Description of Artificial Sequence: Synthetic peptide
PLCVVEELFWGASLYGQCSG

SEQ ID NO: 823 - protein, 20 aa, Artificial Sequence
  Description of Artificial Sequence: Synthetic peptide
RLCVLEELFWGASRFRGCSG

SEQ ID NO: 824 - protein, 20 aa, Artificial Sequence
  Description of Artificial Sequence: Synthetic peptide
PLCVLEELHWGAALFGYCSG

SEQ ID NO: 825 - protein, 20 aa, Artificial Sequence
  Description of Artificial Sequence: Synthetic peptide
NLCVVEELFWGASLFPNCSG

SEQ ID NO: 826 - protein, 20 aa, Artificial Sequence
  Description of Artificial Sequence: Synthetic peptide
QLCVLEELFWGASMFEDCSG

SEQ ID NO: 827 - protein, 20 aa, Artificial Sequence
  Description of Artificial Sequence: Synthetic peptide
HLCVLEEQFWGASLFGQCSG

SEQ ID NO: 828 - protein, 20 aa, Artificial Sequence
  Description of Artificial Sequence: Synthetic peptide
PLCVLEEIYWGAALFGDCYG

SEQ ID NO: 829 - protein, 19 aa, Artificial Sequence
  Description of Artificial Sequence: Synthetic peptide
PLCVLEELFWGLSLDKNCS

SEQ ID NO: 830 - protein, 20 aa, Artificial Sequence
  Description of Artificial Sequence: Synthetic peptide
QLCVLEELFWGASLFSGCSG

SEQ ID NO: 831 - protein, 20 aa, Artificial Sequence
  Description of Artificial Sequence: Synthetic peptide
PLCDLEALFWGESLFGGCSG

SEQ ID NO: 832 - protein, 20 aa, Artificial Sequence
  Description of Artificial Sequence: Synthetic peptide
HLCVLEEMFWGTSHFDGCSG

SEQ ID NO: 833 - protein, 20 aa, Artificial Sequence
  Description of Artificial Sequence: Synthetic peptide
DLCVLEELFWGAPLFGLCSG

SEQ ID NO: 834 - protein, 20 aa, Artificial Sequence
  Description of Artificial Sequence: Synthetic peptide
DLCVLEELFWGVALYGGCSG

SEQ ID NO: 835 - protein, 20 aa, Artificial Sequence
  Description of Artificial Sequence: Synthetic peptide
QLCVLEELYWGASLFGHCSG

SEQ ID NO: 836 - protein, 20 aa, Artificial Sequence
  Description of Artificial Sequence: Synthetic peptide
HLCVLEDRFWGASLFGPCSG

SEQ ID NO: 837 - protein, 20 aa, Artificial Sequence
  Description of Artificial Sequence: Synthetic peptide
HLCGMEEMFWGVALFRNCSG

SEQ ID NO: 838 - protein, 20 aa, Artificial Sequence
  Description of Artificial Sequence: Synthetic peptide
PLCVLEQLYWGESLFVYCSG

SEQ ID NO: 839 - protein, 20 aa, Artificial Sequence
  Description of Artificial Sequence: Synthetic peptide
HLCLLEELFWGEALWGYCSG

SEQ ID NO: 840 - protein, 20 aa, Artificial Sequence
  Description of Artificial Sequence: Synthetic peptide
QLCVMEELFWGASRFGQCSG

SEQ ID NO: 841 - protein, 20 aa, Artificial Sequence
  Description of Artificial Sequence: Synthetic peptide
HLCVLEELFWGASMFGQCSG

SEQ ID NO: 842 - protein, 20 aa, Artificial Sequence
  Description of Artificial Sequence: Synthetic peptide
QLCVLEEMFWGGSRFVQCSA

SEQ ID NO: 843 - protein, 20 aa, Artificial Sequence
  Description of Artificial Sequence: Synthetic peptide
PLCILEELFWGEALFDQCGA

SEQ ID NO: 844 - protein, 20 aa, Artificial Sequence
  Description of Artificial Sequence: Synthetic peptide
YLCVQEELFWGASLFGYCSV

SEQ ID NO: 845 - protein, 20 aa, Artificial Sequence
  Description of Artificial Sequence: Synthetic peptide
HLCALEEAFFGPSLFNSCQG

SEQ ID NO: 846 - protein, 20 aa, Artificial Sequence
  Description of Artificial Sequence: Synthetic peptide
HLCVLEERFWGASLFGQCSG

SEQ ID NO: 847 - protein, 20 aa, Artificial Sequence
  Description of Artificial Sequence: Synthetic peptide
QLCDLEELFWGASLFGYCPG

SEQ ID NO: 848 - protein, 20 aa, Artificial Sequence
  Description of Artificial Sequence: Synthetic peptide
HLCVLEERFWGASIWGSCSG

SEQ ID NO: 849 - protein, 20 aa, Artificial Sequence
  Description of Artificial Sequence: Synthetic peptide
QLCVLEELFWGGSLWGQCSR

SEQ ID NO: 850 - protein, 20 aa, Artificial Sequence
  Description of Artificial Sequence: Synthetic peptide
PLCVLEELFWGAAQFGQCSG

SEQ ID NO: 851 - protein, 20 aa, Artificial Sequence
  Description of Artificial Sequence: Synthetic peptide
QLCDLEERFWGVSLFGLCSG

SEQ ID NO: 852 - protein, 20 aa, Artificial Sequence
  Description of Artificial Sequence: Synthetic peptide
QLCVLEEVFWGASLFGLCTG

SEQ ID NO: 853 - protein, 20 aa, Artificial Sequence
  Description of Artificial Sequence: Synthetic peptide
  MOD_RES (3): Unknown amino acid
QLXDLNTWSGLCLCSVTVRV

SEQ ID NO: 854 - protein, 20 aa, Artificial Sequence
  Description of Artificial Sequence: Synthetic peptide
DLCVLEESLWGKALFGYCSD

SEQ ID NO: 855 - protein, 20 aa, Artificial Sequence
  Description of Artificial Sequence: Synthetic peptide
HLCVLEEVFWGSSMFGDCSG

SEQ ID NO: 856 - protein, 20 aa, Artificial Sequence
  Description of Artificial Sequence: Synthetic peptide
HLCDLEELFWGASLFGDCQG

SEQ ID NO: 857 - protein, 20 aa, Artificial Sequence
  Description of Artificial Sequence: Synthetic peptide
QLCVLDALMWGGCRLGHQCG

SEQ ID NO: 858 - protein, 20 aa, Artificial Sequence
  Description of Artificial Sequence: Synthetic peptide
QLCVLEEKFWGTSLFGDCMG

SEQ ID NO: 859 - protein, 20 aa, Artificial Sequence
  Description of Artificial Sequence: Synthetic peptide
HLCVLEEVFWGAAQFGSCSG

SEQ ID NO: 860 - protein, 20 aa, Artificial Sequence
  Description of Artificial Sequence: Synthetic peptide
QLCVLEELFWGPSMFGYCSG

SEQ ID NO: 861 - protein, 20 aa, Artificial Sequence
  Description of Artificial Sequence: Synthetic peptide
HLCDLEELFWGASGFAQCYG

SEQ ID NO: 862 - protein, 20 aa, Artificial Sequence
  Description of Artificial Sequence: Synthetic peptide
DLCVLEERFWGASLFGQCSG

SEQ ID NO: 863 - protein, 20 aa, Artificial Sequence
  Description of Artificial Sequence: Synthetic peptide
QLCVLEELHWGASLFGYCSG

SEQ ID NO: 864 - protein, 20 aa, Artificial Sequence
  Description of Artificial Sequence: Synthetic peptide
PLCVLEEQFWGASLFGQCSG

SEQ ID NO: 865 - protein, 20 aa, Artificial Sequence
  Description of Artificial Sequence: Synthetic peptide
YLCDLEERFWGASLFGQCSS

SEQ ID NO: 866 - protein, 20 aa, Artificial Sequence
  Description of Artificial Sequence: Synthetic peptide
HLCLLEERFWGSSQFGFCSG

SEQ ID NO: 867 - protein, 20 aa, Artificial Sequence
  Description of Artificial Sequence: Synthetic peptide
HLCVLEELFWGASQFGQCSG

SEQ ID NO: 868 - protein, 20 aa, Artificial Sequence
  Description of Artificial Sequence: Synthetic peptide
HLCYLEERFWGASLFGQCSG

SEQ ID NO: 869 - protein, 20 aa, Artificial Sequence
  Description of Artificial Sequence: Synthetic peptide
HLCVMEELFWGTSLFGQCTG

SEQ ID NO: 870 - protein, 20 aa, Artificial Sequence
  Description of Artificial Sequence: Synthetic peptide
HLCVLEERFWGASLFGQCSG

SEQ ID NO: 871 - protein, 20 aa, Artificial Sequence
  Description of Artificial Sequence: Synthetic peptide
HLCVLEERFWGASLFSQCSG

SEQ ID NO: 872 - protein, 20 aa, Artificial Sequence
  Description of Artificial Sequence: Synthetic peptide
HLCVLEELFWGASLFGQCSG

SEQ ID NO: 873 - protein, 20 aa, Artificial Sequence
  Description of Artificial Sequence: Synthetic peptide
QLCLLEELFWGAASFGQCSG

SEQ ID NO: 874 - protein, 20 aa, Artificial Sequence
  Description of Artificial Sequence: Synthetic peptide
HLCVLEEMFWGASLFGQCSG

SEQ ID NO: 875 - protein, 20 aa, Artificial Sequence
  Description of Artificial Sequence: Synthetic peptide
HLCDLEELFWGASLFSQCSR

SEQ ID NO: 876 - protein, 20 aa, Artificial Sequence
  Description of Artificial Sequence: Synthetic peptide
QLCVLEELFWGASQFGYCSG

SEQ ID NO: 877 - protein, 20 aa, Artificial Sequence
  Description of Artificial Sequence: Synthetic peptide
QLCALEEQFWGASLFSQCSG

SEQ ID NO: 878 - protein, 20 aa, Artificial Sequence
  Description of Artificial Sequence: Synthetic peptide
QLCVLEELFWGASLFGYCSG

SEQ ID NO: 879 - protein, 20 aa, Artificial Sequence
  Description of Artificial Sequence: Synthetic peptide
HLCVLEEWFWGDSLFGQCSR

SEQ ID NO: 880 - protein, 20 aa, Artificial Sequence
  Description of Artificial Sequence: Synthetic peptide
HLCVLEERFWGASLFGQCSG

SEQ ID NO: 881 - protein, 20 aa, Artificial Sequence
  Description of Artificial Sequence: Synthetic peptide
QLCELEEVFWGASLFDYCSG

SEQ ID NO: 882 - protein, 20 aa, Artificial Sequence
  Description of Artificial Sequence: Synthetic peptide
HLCVLEELFWGASRFGQCSG

SEQ ID NO: 883 - protein, 20 aa, Artificial Sequence
  Description of Artificial Sequence: Synthetic peptide
HLCVLEELFWGASLFGQCSA

SEQ ID NO: 884 - protein, 20 aa, Artificial Sequence
  Description of Artificial Sequence: Synthetic peptide
HLCVLEELIWGASRFGQCSG

SEQ ID NO: 885 - protein, 20 aa, Artificial Sequence
  Description of Artificial Sequence: Synthetic peptide
HLCVLEELFWGGSLFIQCSG

SEQ ID NO: 886 - protein, 20 aa, Artificial Sequence
  Description of Artificial Sequence: Synthetic peptide
QLCVLEEQFWGASLFGNCSG

SEQ ID NO: 887 - protein, 20 aa, Artificial Sequence
  Description of Artificial Sequence: Synthetic peptide
HLCVLEERFWGAALFGQCSG

SEQ ID NO: 888 - protein, 20 aa, Artificial Sequence
  Description of Artificial Sequence: Synthetic peptide
HLCILEEMFWGASLFGQCGG

SEQ ID NO: 889 - protein, 20 aa, Artificial Sequence
  Description of Artificial Sequence: Synthetic peptide
PLCVLEELVWGASLFVQCSG

SEQ ID NO: 890 - protein, 20 aa, Artificial Sequence
  Description of Artificial Sequence: Synthetic peptide
NLCVLEELFWGESLFGQCSG

SEQ ID NO: 891 - protein, 20 aa, Artificial Sequence
  Description of Artificial Sequence: Synthetic peptide
HLCVLEEQFWGGSLFGYCSR

SEQ ID NO: 892 - protein, 20 aa, Artificial Sequence
  Description of Artificial Sequence: Synthetic peptide
HLCFLEEVFWGAALFAQCSG

SEQ ID NO: 893 - protein, 20 aa, Artificial Sequence
  Description of Artificial Sequence: Synthetic peptide
HLCDLEVLFWGSALFGQCSG

SEQ ID NO: 894 - protein, 20 aa, Artificial Sequence
  Description of Artificial Sequence: Synthetic peptide
HLCVMEELFWGASLFGQCSG

SEQ ID NO: 895 - protein, 20 aa, Artificial Sequence
  Description of Artificial Sequence: Synthetic peptide
HLCVLEERFWGASLFWQCSG

SEQ ID NO: 896 - protein, 20 aa, Artificial Sequence
  Description of Artificial Sequence: Synthetic peptide
HLCVLEEQYWGESLFGYCSG

SEQ ID NO: 897 - protein, 20 aa, Artificial Sequence
  Description of Artificial Sequence: Synthetic peptide
PLCVLEEQFWGASLFAYCSS

SEQ ID NO: 898 - protein, 20 aa, Artificial Sequence
  Description of Artificial Sequence: Synthetic peptide
QLCVLEELFWGESLFAQCLG

SEQ ID NO: 899 - protein, 20 aa, Artificial Sequence
  Description of Artificial Sequence: Synthetic peptide
HLCVLEELFWGQSLFGHCSD

SEQ ID NO: 900 - protein, 20 aa, Artificial Sequence
  Description of Artificial Sequence: Synthetic peptide
HLCVLEELVWGASLFGFCSG

SEQ ID NO: 901 - protein, 20 aa, Artificial Sequence
  Description of Artificial Sequence: Synthetic peptide
LLCVLEEQFWGASLFGQCSG

SEQ ID NO: 902 - protein, 20 aa, Artificial Sequence
  Description of Artificial Sequence: Synthetic peptide
RLCVLEELFWGESLFGQCSG

SEQ ID NO: 903 - protein, 20 aa, Artificial Sequence
  Description of Artificial Sequence: Synthetic peptide
HLCVLEEMFWGASLFGNCSG

SEQ ID NO: 904 - protein, 20 aa, Artificial Sequence
  Description of Artificial Sequence: Synthetic peptide
ELCFLEELFWGASLFGQCSG

SEQ ID NO: 905 - protein, 20 aa, Artificial Sequence
  Description of Artificial Sequence: Synthetic peptide
HLCVLEELFWGASLYGQCSS

SEQ ID NO: 906 - protein, 20 aa, Artificial Sequence
  Description of Artificial Sequence: Synthetic peptide
HLCVLEELFWGASLFAQCPG

SEQ ID NO: 907 - protein, 20 aa, Artificial Sequence
  Description of Artificial Sequence: Synthetic peptide
NLCVLEELFWGASEFGQCSG

SEQ ID NO: 908 - protein, 20 aa, Artificial Sequence
  Description of Artificial Sequence: Synthetic peptide
DLCVLEEQLWGASLFRYCSG

SEQ ID NO: 909 - protein, 20 aa, Artificial Sequence
  Description of Artificial Sequence: Synthetic peptide
HLCVLEEQFWGVALFGNCSG

SEQ ID NO: 910 - protein, 20 aa, Artificial Sequence
  Description of Artificial Sequence: Synthetic peptide
HLCVLEVQIWGASLFGQCSG

SEQ ID NO: 911 - protein, 20 aa, Artificial Sequence
  Description of Artificial Sequence: Synthetic peptide
HLCVLEERFWGGALFGQCTA

SEQ ID NO: 912 - protein, 20 aa, Artificial Sequence
  Description of Artificial Sequence: Synthetic peptide
HLCDLEELFWGASLFGQCSG

SEQ ID NO: 913 - protein, 20 aa, Artificial Sequence
  Description of Artificial Sequence: Synthetic peptide
QLCVLEELFWGTSLFAGCSG

SEQ ID NO: 914 - protein, 20 aa, Artificial Sequence
  Description of Artificial Sequence: Synthetic peptide
QLCGLEELFWGASLFGYCSA

SEQ ID NO: 915 - protein, 20 aa, Artificial Sequence
  Description of Artificial Sequence: Synthetic peptide
HLCVLEELFWGASLFGQCSS

SEQ ID NO: 916 - protein, 20 aa, Artificial Sequence
  Description of Artificial Sequence: Synthetic peptide
FLCVLEELYWGASQFGQCSG

SEQ ID NO: 917 - protein, 20 aa, Artificial Sequence
  Description of Artificial Sequence: Synthetic peptide
HLCVLEEQFWGASLFGYCSG

SEQ ID NO: 918 - protein, 20 aa, Artificial Sequence
  Description of Artificial Sequence: Synthetic peptide
RLCALEELFWGASLFGQCSG

SEQ ID NO: 919 - protein, 20 aa, Artificial Sequence
  Description of Artificial Sequence: Synthetic peptide
HLCVLEELFWGAALFHQCSG

SEQ ID NO: 920 - protein, 20 aa, Artificial Sequence
  Description of Artificial Sequence: Synthetic peptide
RLCVLEEQFWGASLFGQCSG

SEQ ID NO: 921 - protein, 20 aa, Artificial Sequence
  Description of Artificial Sequence: Synthetic peptide
QLCVLEELFWGSSRLGYCSG

SEQ ID NO: 922 - protein, 20 aa, Artificial Sequence
  Description of Artificial Sequence: Synthetic peptide
DLCVLEELFWGASLFGQCSG

SEQ ID NO: 923 - protein, 20 aa, Artificial Sequence
  Description of Artificial Sequence: Synthetic peptide
QLCLLEEQFWGGSLFGQCSG

SEQ ID NO: 924 - protein, 20 aa, Artificial Sequence
  Description of Artificial Sequence: Synthetic peptide
HLCVLEELFWGTSLFGQCSG

SEQ ID NO: 925 - protein, 20 aa, Artificial Sequence
  Description of Artificial Sequence: Synthetic peptide
RLCVLEELVWGASLFDQCSR

SEQ ID NO: 926 - protein, 20 aa, Artificial Sequence
  Description of Artificial Sequence: Synthetic peptide
EIEAEWGRVRCLVYGRCVGG

SEQ ID NO: 927 - protein, 20 aa, Artificial Sequence
  Description of Artificial Sequence: Synthetic peptide
EIEAEWGRVRCLVYGRCVGG

SEQ ID NO: 928 - protein, 20 aa, Artificial Sequence
  Description of Artificial Sequence: Synthetic peptide
WLDQEWAWVQCEVYGRGCPS

SEQ ID NO: 929 - protein, 20 aa, Artificial Sequence
  Description of Artificial Sequence: Synthetic peptide
WLDQEWAWVQCEVYGRGCPS

SEQ ID NO: 930 - protein, 20 aa, Artificial Sequence
  Description of Artificial Sequence: Synthetic peptide
WLDLEWAQVQCEVYGRGCPS

SEQ ID NO: 931 - protein, 20 aa, Artificial Sequence
  Description of Artificial Sequence: Synthetic peptide
WLDQEWAQVQCEVFGRGCPS

SEQ ID NO: 932 - protein, 20 aa, Artificial Sequence
  Description of Artificial Sequence: Synthetic peptide
WLDQEWQQVQCQVYGRGCTS

SEQ ID NO: 933 - protein, 20 aa, Artificial Sequence
  Description of Artificial Sequence: Synthetic peptide
RLDEEWARVQCEVWGRGCRS

SEQ ID NO: 934 - protein, 20 aa, Artificial Sequence
  Description of Artificial Sequence: Synthetic peptide
WLEQEWAWIQCEVYGRGCPS

SEQ ID NO: 935 - protein, 20 aa, Artificial Sequence
  Description of Artificial Sequence: Synthetic peptide
WLEQEWAQVQCEVYGRGCPS

SEQ ID NO: 936 - protein, 20 aa, Artificial Sequence
  Description of Artificial Sequence: Synthetic peptide
WLDEEWEWIQCKVYGRGCPA

SEQ ID NO: 937 - protein, 20 aa, Artificial Sequence
  Description of Artificial Sequence: Synthetic peptide
WLEQEWAWVQCEVYGRGCQS

SEQ ID NO: 938 - protein, 20 aa, Artificial Sequence
  Description of Artificial Sequence: Synthetic peptide
WLDQEWAWIQCEVYGRGCPA

SEQ ID NO: 939 - protein, 20 aa, Artificial Sequence
  Description of Artificial Sequence: Synthetic peptide
SLDWEWAWLQCEVYGRGCPS

SEQ ID NO: 940 - protein, 20 aa, Artificial Sequence
  Description of Artificial Sequence: Synthetic peptide
WLEQEWEQVRCLVYGRGCPP

SEQ ID NO: 941 - protein, 20 aa, Artificial Sequence
  Description of Artificial Sequence: Synthetic peptide
WLDQEWAWVQCEVYGRGCPY

SEQ ID NO: 942 - protein, 20 aa, Artificial Sequence
  Description of Artificial Sequence: Synthetic peptide
WLDQEWAGVLCEVYGRGCPS

SEQ ID NO: 943 - protein, 20 aa, Artificial Sequence
  Description of Artificial Sequence: Synthetic peptide
SLDKEWEWVLCVVYGRGCPS

SEQ ID NO: 944 - protein, 20 aa, Artificial Sequence
  Description of Artificial Sequence: Synthetic peptide
WLEQEWAQVQCEVYGRGCRS

SEQ ID NO: 945 - protein, 20 aa, Artificial Sequence
  Description of Artificial Sequence: Synthetic peptide
WLEEEWAQVQCAVYGRGCSS

SEQ ID NO: 946 - protein, 20 aa, Artificial Sequence
  Description of Artificial Sequence: Synthetic peptide
WLDQEWALVQCEVYGRGCPS

SEQ ID NO: 947 - protein, 20 aa, Artificial Sequence
  Description of Artificial Sequence: Synthetic peptide
WLDQEWAWVQCEVYGRGCPS

SEQ ID NO: 948 - protein, 20 aa, Artificial Sequence
  Description of Artificial Sequence: Synthetic peptide
WLEQEWAWVQCEVYGRGCAS

SEQ ID NO: 949 - protein, 20 aa, Artificial Sequence
  Description of Artificial Sequence: Synthetic peptide
WLDQEWAWVECEVYGRRCPS

SEQ ID NO: 950 - protein, 20 aa, Artificial Sequence
  Description of Artificial Sequence: Synthetic peptide
WLDQEWAWVECQVYGRGCPS

SEQ ID NO: 951 - protein, 20 aa, Artificial Sequence
  Description of Artificial Sequence: Synthetic peptide
QLDQEWAWVLCKVYGRGCPS

SEQ ID NO: 952 - protein, 20 aa, Artificial Sequence
  Description of Artificial Sequence: Synthetic peptide
  MOD_RES (6): Unknown amino acid; translation read-through at TGA stop codon
WLDHEXAWVQCEVYGRGCPS

SEQ ID NO: 953 - protein, 20 aa, Artificial Sequence
  Description of Artificial Sequence: Synthetic peptide
QLEQEWAWVRCEVYGRGCSS

SEQ ID NO: 954 - protein, 20 aa, Artificial Sequence
  Description of Artificial Sequence: Synthetic peptide
WLDQEWAWVQCQVYGRGCLS

SEQ ID NO: 955 - protein, 20 aa, Artificial Sequence
  Description of Artificial Sequence: Synthetic peptide
WLDQEWAWVRCEVYGLGCPS

SEQ ID NO: 956 - protein, 20 aa, Artificial Sequence
  Description of Artificial Sequence: Synthetic peptide
WLDQEWAVMKCELYGRGCPS

SEQ ID NO: 957 - protein, 20 aa, Artificial Sequence
  Description of Artificial Sequence: Synthetic peptide
WLEQEWAWVQCEVYGRGCLS

SEQ ID NO: 958 - protein, 20 aa, Artificial Sequence
  Description of Artificial Sequence: Synthetic peptide
SLDQEWAWVQCEVYGRGCLS

SEQ ID NO: 959 - protein, 20 aa, Artificial Sequence
  Description of Artificial Sequence: Synthetic peptide
WLDHEWAWVQCEVYGRGCTS

SEQ ID NO: 960 - protein, 20 aa, Artificial Sequence
  Description of Artificial Sequence: Synthetic peptide
WLDVEWAWVQCEVYGRGCPS

SEQ ID NO: 961 - protein, 20 aa, Artificial Sequence
  Description of Artificial Sequence: Synthetic peptide
QLDQEWARVRCEVWGRGCSS

SEQ ID NO: 962 - protein, 20 aa, Artificial Sequence
  Description of Artificial Sequence: Synthetic peptide
WLDLEWAQVQCKVYGRGCPS

SEQ ID NO: 963 - protein, 20 aa, Artificial Sequence
  Description of Artificial Sequence: Synthetic peptide
WLDEEWAWVQCQVYGRGCPS

SEQ ID NO: 964 - protein, 20 aa, Artificial Sequence
  Description of Artificial Sequence: Synthetic peptide
WLDQEWAWVQCEVWGRGCAF

SEQ ID NO: 965 - protein, 20 aa, Artificial Sequence
  Description of Artificial Sequence: Synthetic peptide
WLDREWAQVQCEVYGRGCLS

SEQ ID NO: 966 - protein, 20 aa, Artificial Sequence
  Description of Artificial Sequence: Synthetic peptide
WLDAEWEWVQCEVYGRGCRP

SEQ ID NO: 967 - protein, 20 aa, Artificial Sequence
  Description of Artificial Sequence: Synthetic peptide
SLDREWAYVQCQVYGRGCSS

SEQ ID NO: 968 - protein, 20 aa, Artificial Sequence
  Description of Artificial Sequence: Synthetic peptide
RLDLEWANIQCEVYGRGCPS

SEQ ID NO: 969 - protein, 20 aa, Artificial Sequence
  Description of Artificial Sequence: Synthetic peptide
WLEQEWARVQCEVYGRGCSS

SEQ ID NO: 970 - protein, 20 aa, Artificial Sequence
  Description of Artificial Sequence: Synthetic peptide
WLEQEWILVECEVYGRGCPT

SEQ ID NO: 971 - protein, 20 aa, Artificial Sequence
  Description of Artificial Sequence: Synthetic peptide
WLEQEWAQVQCEVWGRGCPS

SEQ ID NO: 972 - protein, 20 aa, Artificial Sequence
  Description of Artificial Sequence: Synthetic peptide
WLDQEWEWIQCEVYGRGCPL

SEQ ID NO: 973 - protein, 20 aa, Artificial Sequence
  Description of Artificial Sequence: Synthetic peptide
LLDEEWAQIECEIYGRGCPS

SEQ ID NO: 974 - protein, 20 aa, Artificial Sequence
  Description of Artificial Sequence: Synthetic peptide
ALEEEWAWVQCEVYGRGCHF

SEQ ID NO: 975 - protein, 20 aa, Artificial Sequence
  Description of Artificial Sequence: Synthetic peptide
  MOD_RES (2): Unknown amino acid
CXEQEWGLVQCEVYGRGCPS

SEQ ID NO: 976 - protein, 20 aa, Artificial Sequence
  Description of Artificial Sequence: Synthetic peptide
WLEQEWAYVQCEVYGRGCPS

SEQ ID NO: 977 - protein, 20 aa, Artificial Sequence
  Description of Artificial Sequence: Synthetic peptide
WLEHEWAQVQCEVWGRGCPY

SEQ ID NO: 978 - protein, 20 aa, Artificial Sequence
  Description of Artificial Sequence: Synthetic peptide
WLEQEWAEVRCEVYGRGCPR

SEQ ID NO: 979 - protein, 20 aa, Artificial Sequence
  Description of Artificial Sequence: Synthetic peptide
  MOD_RES (1): Unknown amino acid
XLEQEWAWVQCEVYGRGCPS

SEQ ID NO: 980 - protein, 20 aa, Artificial Sequence
  Description of Artificial Sequence: Synthetic peptide
WLEQEWAGIQCKVYGRGCPS

SEQ ID NO: 981 - protein, 20 aa, Artificial Sequence
  Description of Artificial Sequence: Synthetic peptide
RLEQEWAQVQCEVWGRGCLP

SEQ ID NO: 982 - protein, 20 aa, Artificial Sequence
  Description of Artificial Sequence: Synthetic peptide
QLDHEWAGIQCEVWGRGCPS

SEQ ID NO: 983 - protein, 20 aa, Artificial Sequence
  Description of Artificial Sequence: Synthetic peptide
WLEQEWAQIQCEVYGAGCRS

SEQ ID NO: 984 - protein, 20 aa, Artificial Sequence
  Description of Artificial Sequence: Synthetic peptide
SLEQEWAWVQCVVYGRGCPI

SEQ ID NO: 985 - protein, 20 aa, Artificial Sequence
  Description of Artificial Sequence: Synthetic peptide
WLEQEWDQVLCEVYGRGCPY

SEQ ID NO: 986 - protein, 20 aa, Artificial Sequence
  Description of Artificial Sequence: Synthetic peptide
  MOD_RES (10): Unknown amino acid
  MOD_RES (20): Unknown amino acid
WLEQEWAQVXCEVYGRGCAX

SEQ ID NO: 987 - protein, 20 aa, Artificial Sequence
  Description of Artificial Sequence: Synthetic peptide
WMDQEWAWVQCEVYGRGCPS

SEQ ID NO: 988 - protein, 20 aa, Artificial Sequence
  Description of Artificial Sequence: Synthetic peptide
QLDQEWAWIQCEVYGRNCRT

SEQ ID NO: 989 - protein, 20 aa, Artificial Sequence
  Description of Artificial Sequence: Synthetic peptide
TLEQEWAQVICEVYGRGCLS

SEQ ID NO: 990 - protein, 20 aa, Artificial Sequence
  Description of Artificial Sequence: Synthetic peptide
RLEQEWAQVQCEVWGRGCLS

SEQ ID NO: 991 - protein, 20 aa, Artificial Sequence
  Description of Artificial Sequence: Synthetic peptide
WLDQEWALVQCEVYGRGCPA

SEQ ID NO: 992 - protein, 20 aa, Artificial Sequence
  Description of Artificial Sequence: Synthetic peptide
WLDQEWAQIQCHVWGRGCPA

SEQ ID NO: 993 - protein, 20 aa, Artificial Sequence
  Description of Artificial Sequence: Synthetic peptide
WLEQEWAWVQCEVYGRGCPS

SEQ ID NO: 994 - protein, 20 aa, Artificial Sequence
  Description of Artificial Sequence: Synthetic peptide
RLEEEWAWVQCQVYGRGCPS

SEQ ID NO: 995 - protein, 20 aa, Artificial Sequence
  Description of Artificial Sequence: Synthetic peptide
WLEQEWVRIQCEVYGRGCPS

SEQ ID NO: 996 - protein, 20 aa, Artificial Sequence
  Description of Artificial Sequence: Synthetic peptide
WLEQEWTWVQCEVYGCGCPS

SEQ ID NO: 997 - protein, 20 aa, Artificial Sequence
  Description of Artificial Sequence: Synthetic peptide
WLEKEWAGVQCEIYGRGCPS

SEQ ID NO: 998 - protein, 20 aa, Artificial Sequence
  Description of Artificial Sequence: Synthetic peptide
WLEEEWAWVRCEVYGRGCQS

SEQ ID NO: 999 - protein, 20 aa, Artificial Sequence
  Description of Artificial Sequence: Synthetic peptide
WLEHEWAQIQCELYGRGCTY

SEQ ID NO: 1000 - protein, 20 aa, Artificial Sequence
  Description of Artificial Sequence: Synthetic peptide
ALEEEWAWVQCEVYGRGCPS

SEQ ID NO: 1001 - protein, 20 aa, Artificial Sequence
  Description of Artificial Sequence: Synthetic peptide
WLEQEWAQVQCEVYGRGCPS

SEQ ID NO: 1002 - protein, 20 aa, Artificial Sequence
  Description of Artificial Sequence: Synthetic peptide
WLDDEWAQIQCEIYGRGCQS

SEQ ID NO: 1003 - protein, 20 aa, Artificial Sequence
  Description of Artificial Sequence: Synthetic peptide
QLEEEWAGVQCEVYGRECPS

SEQ ID NO: 1004 - protein, 20 aa, Artificial Sequence
  Description of Artificial Sequence: Synthetic peptide
WLEQEWLLVQCGVYGRGCPS

SEQ ID NO: 1005 - protein, 20 aa, Artificial Sequence
  Description of Artificial Sequence: Synthetic peptide
WLDQEWAWIQCEVYGRGCRS

SEQ ID NO: 1006 - protein, 20 aa, Artificial Sequence
  Description of Artificial Sequence: Synthetic peptide
WLEQEWAQVQCEVSGRGCPS

SEQ ID NO: 1007 - protein, 20 aa, Artificial Sequence
  Description of Artificial Sequence: Synthetic peptide
  MOD_RES (2): Unknown amino acid
WXDQEWALIQCEVYGRGCPS

SEQ ID NO: 1008 - protein, 20 aa, Artificial Sequence
  Description of Artificial Sequence: Synthetic peptide
SLDEEWAGVLCEVYGRGCPF

SEQ ID NO: 1009 - protein, 20 aa, Artificial Sequence
  Description of Artificial Sequence: Synthetic peptide
SVDQELEWLMCHFQGRVCPS

SEQ ID NO: 1010 - protein, 20 aa, Artificial Sequence
  Description of Artificial Sequence: Synthetic peptide
WLEQERAWIWCEIQGSGCRA

SEQ ID NO: 1011 - protein, 20 aa, Artificial Sequence
  Description of Artificial Sequence: Synthetic peptide
WVNQALGGVQSDVQGRRCQS

SEQ ID NO: 1012 - protein, 20 aa, Artificial Sequence
  Description of Artificial Sequence: Synthetic peptide
LLDHEWPWVGCEVCGRGSLS

SEQ ID NO: 1013 - protein, 20 aa, Artificial Sequence
  Description of Artificial Sequence: Synthetic peptide
WLHQELAWVRGEGYPRGRRS

SEQ ID NO: 1014 - protein, 20 aa, Artificial Sequence
  Description of Artificial Sequence: Synthetic peptide
WLGHDWAWIQCEVYGLGCPC

SEQ ID NO: 1015 - protein, 20 aa, Artificial Sequence
  Description of Artificial Sequence: Synthetic peptide
  MOD_RES (14): Unknown amino acid; translation read-through at TGA stop codon
WIDQEGVRVQCEAXGRAFPS

SEQ ID NO: 1016 - protein, 20 aa, Artificial Sequence
  Description of Artificial Sequence: Synthetic peptide
WRDEEWAWVQGVVQGRGWPA

SEQ ID NO: 1017 - protein, 20 aa, Artificial Sequence
  Description of Artificial Sequence: Synthetic peptide
RLGVEWSWFQRKVYGRDSTS

SEQ ID NO: 1018 - protein, 20 aa, Artificial Sequence
  Description of Artificial Sequence: Synthetic peptide
WLAQGWAGVQCVVYGRGCRN

SEQ ID NO: 1019 - protein, 20 aa, Artificial Sequence
  Description of Artificial Sequence: Synthetic peptide
  MOD_RES (6): Unknown amino acid; translation read-through at TGA stop codon
  MOD_RES (14): Unknown amino acid
WLEEEXAGIQCQVXGRGCPS

SEQ ID NO: 1020 - protein, 20 aa, Artificial Sequence
  Description of Artificial Sequence: Synthetic peptide
WLDQEWEWVQCEVWGRGCLS

SEQ ID NO: 1021 - protein, 20 aa, Artificial Sequence
  Description of Artificial Sequence: Synthetic peptide
RLEQEWALIQCEVYGRGCPS

SEQ ID NO: 1022 - protein, 20 aa, Artificial Sequence
  Description of Artificial Sequence: Synthetic peptide
WLEEEWAQVQCQVYGRGCAS

SEQ ID NO: 1023 - protein, 20 aa, Artificial Sequence
  Description of Artificial Sequence: Synthetic peptide
  MOD_RES (6): Unknown amino acid; translation read-through at TGA stop codon
WLDLEXEWLQCEVYGRGCAT

SEQ ID NO: 1024 - protein, 20 aa, Artificial Sequence
  Description of Artificial Sequence: Synthetic peptide
WLEQEWVQVRCEVYGRGCPS

SEQ ID NO: 1025 - protein, 20 aa, Artificial Sequence
  Description of Artificial Sequence: Synthetic peptide
WLEEEWAQVQCEVYGRGCPS

SEQ ID NO: 1026 - protein, 20 aa, Artificial Sequence
  Description of Artificial Sequence: Synthetic peptide
WLDQEWARVQCEVWGRGCTY

SEQ ID NO: 1027 - protein, 20 aa, Artificial Sequence
  Description of Artificial Sequence: Synthetic peptide
  MOD_RES (4): Unknown amino acid
YLDXEWAWVQCEVYGLGCQS

SEQ ID NO: 1028 - protein, 20 aa, Artificial Sequence
  Description of Artificial Sequence: Synthetic peptide
  MOD_RES (6): Unknown amino acid; translation read-through at TGA stop codon
WLDVEXAWVQCEVWGRGCPS

SEQ ID NO: 1029 - protein, 20 aa, Artificial Sequence
  Description of Artificial Sequence: Synthetic peptide
  MOD_RES (9): Unknown amino acid
WLEQEWERXQCEVYGRGCPP

SEQ ID NO: 1030 - protein, 20 aa, Artificial Sequence
  Description of Artificial Sequence: Synthetic peptide
WLEEEWAQVQCEVYGRGCLS

SEQ ID NO: 1031 - protein, 20 aa, Artificial Sequence
  Description of Artificial Sequence: Synthetic peptide
WLDQEWAWIQCEVYGRGCPS

SEQ ID NO: 1032 - protein, 20 aa, Artificial Sequence
  Description of Artificial Sequence: Synthetic peptide
  MOD_RES (1): Unknown amino acid
  MOD_RES (14): Unknown amino acid
XLEHEWAQIQCEVXGRGCQS

SEQ ID NO: 1033 - protein, 20 aa, Artificial Sequence
  Description of Artificial Sequence: Synthetic peptide
  MOD_RES (3): Unknown amino acid
WLXQEWAWIQCEVYGRGCPF

SEQ ID NO: 1034 - protein, 20 aa, Artificial Sequence
  Description of Artificial Sequence: Synthetic peptide
  MOD_RES (4): Unknown amino acid
WLDXEWAWVQCEVYGRGCPS

SEQ ID NO: 1035 - protein, 20 aa, Artificial Sequence
  Description of Artificial Sequence: Synthetic peptide
GLEQGCPWVGLEVQCRGCPS

SEQ ID NO: 1036 - protein, 20 aa, Artificial Sequence
  Description of Artificial Sequence: Synthetic peptide
WLEEEWAWVQCEVYGHGCPS

SEQ ID NO: 1037 - protein, 20 aa, Artificial Sequence
  Description of Artificial Sequence: Synthetic peptide
WLDQEWAQIQCEVYGRGCSS

SEQ ID NO: 1038 - protein, 20 aa, Artificial Sequence
  Description of Artificial Sequence: Synthetic peptide
WLDQEWAQVQCEVWGRGCPS

SEQ ID NO: 1039 - protein, 20 aa, Artificial Sequence
  Description of Artificial Sequence: Synthetic peptide
WLDLEWEFVQCEVYGRGCPT

SEQ ID NO: 1040 - protein, 20 aa, Artificial Sequence
  Description of Artificial Sequence: Synthetic peptide
WLEQEWASVQCEVYGRGCPS

SEQ ID NO: 1041 - protein, 20 aa, Artificial Sequence
  Description of Artificial Sequence: Synthetic peptide
WLDLEWEQIKCKVYGRGCPF

SEQ ID NO: 1042 - protein, 20 aa, Artificial Sequence
  Description of Artificial Sequence: Synthetic peptide
WLEQEWAQIQCQIYGRGCPS

SEQ ID NO: 1043 - protein, 20 aa, Artificial Sequence
  Description of Artificial Sequence: Synthetic peptide
WLEQEWALVLCEVYGHGCPA

SEQ ID NO: 1044 - protein, 20 aa, Artificial Sequence
  Description of Artificial Sequence: Synthetic peptide
WLEQEWAQIQCEVWGRGCSS

SEQ ID NO: 1045 - protein, 20 aa, Artificial Sequence
  Description of Artificial Sequence: Synthetic peptide
  MOD_RES (4): Unknown amino acid
  MOD_RES (19): Unknown amino acid
WLEXEWEWVQCEVYGRGCXS

SEQ ID NO: 1046 - protein, 20 aa, Artificial Sequence
  Description of Artificial Sequence: Synthetic peptide
WLEQEWAQVQCDVYGRGCPS

SEQ ID NO: 1047 - protein, 20 aa, Artificial Sequence
  Description of Artificial Sequence: Synthetic peptide
  MOD_RES (6): Unknown amino acid; translation read-through at TGA stop codon
WLEQEXARVQCEVWGRGCPS

SEQ ID NO: 1048 - protein, 20 aa, Artificial Sequence
  Description of Artificial Sequence: Synthetic peptide
  MOD_RES (3): Unknown amino acid
  MOD_RES (18): Unknown amino acid
WLXQEWARVHCEVWGRPXQC

SEQ ID NO: 1049 - protein, 20 aa, Artificial Sequence
  Description of Artificial Sequence: Synthetic peptide
PLEHEWAWVQCVVYGRGCRS

SEQ ID NO: 1050 - protein, 20 aa, Artificial Sequence
  Description of Artificial Sequence: Synthetic peptide
  MOD_RES (4): Unknown amino acid
  MOD_RES (14): Unknown amino acid
  MOD_RES (20): Unknown amino acid
SLEXEWAWVQCEVXGRGCPX

SEQ ID NO: 1051 - protein, 20 aa, Artificial Sequence
  Description of Artificial Sequence: Synthetic peptide
WLDQEWVRVQCEVWGRGCPS

SEQ ID NO: 1052 - protein, 20 aa, Artificial Sequence
  Description of Artificial Sequence: Synthetic peptide
SLDKEWAWVKCEVYGRGCPS

SEQ ID NO: 1053 - protein, 20 aa, Artificial Sequence
  Description of Artificial Sequence: Synthetic peptide
  MOD_RES (14): Unknown amino acid; translation read-through at TAA stop codon
LGDQEWAWVEWEVXGRGWPS

SEQ ID NO: 1054 - protein, 20 aa, Artificial Sequence
  Description of Artificial Sequence: Synthetic peptide
WLEEEWAQIRCGVYGRGCPS

SEQ ID NO: 1055 - protein, 20 aa, Artificial Sequence
  Description of Artificial Sequence: Synthetic peptide
  MOD_RES (6): Unknown amino acid; translation read-through at TGA stop codon
WLEEEXGWVQCEVWGRGCPP

SEQ ID NO: 1056 - protein, 20 aa, Artificial Sequence
  Description of Artificial Sequence: Synthetic peptide
  MOD_RES (8): Unknown amino acid
CLDQEWAXVQCPVYGRGCPS

SEQ ID NO: 1057 - protein, 20 aa, Artificial Sequence
  Description of Artificial Sequence: Synthetic peptide
QLELEWARVQCEVWDRGCPS

SEQ ID NO: 1058 - protein, 20 aa, Artificial Sequence
  Description of Artificial Sequence: Synthetic peptide
RLEQEWAWIQCEVYGRGCRF

SEQ ID NO: 1059 - protein, 20 aa, Artificial Sequence
  Description of Artificial Sequence: Synthetic peptide
  MOD_RES (6): Unknown amino acid; translation read-through at TGA stop codon
  MOD_RES (19): Unknown amino acid
SLEHEXAWVQCKVYGRGCXS

SEQ ID NO: 1060 - protein, 20 aa, Artificial Sequence
  Description of Artificial Sequence: Synthetic peptide
WLDQEWAWIQCEVYGRGCPP

SEQ ID NO: 1061 - protein, 20 aa, Artificial Sequence
  Description of Artificial Sequence: Synthetic peptide
WLDQEWAQVRCEVYGRGCPS

SEQ ID NO: 1062 - protein, 20 aa, Artificial Sequence
  Description of Artificial Sequence: Synthetic peptide
PKGTRFRGDVDVWDGYSWLA

SEQ ID NO: 1063 - protein, 20 aa, Artificial Sequence
  Description of Artificial Sequence: Synthetic peptide
TPIPAGGINIASWGGYTWLS

SEQ ID NO: 1064 - protein, 20 aa, Artificial Sequence
  Description of Artificial Sequence: Synthetic peptide
HRGTVTGVWVARWPGYEWLS

SEQ ID NO: 1065 - protein, 20 aa, Artificial Sequence
  Description of Artificial Sequence: Synthetic peptide
SDVWAQPQRRNDWPGYHWLS

SEQ ID NO: 1066 - protein, 20 aa, Artificial Sequence
  Description of Artificial Sequence: Synthetic peptide
HRGTVTGVWVARWPGYEWLS

SEQ ID NO: 1067 - protein, 20 aa, Artificial Sequence
  Description of Artificial Sequence: Synthetic peptide
SDVWAQPQRRNDWPGYHWLS

SEQ ID NO: 1068 - protein, 20 aa, Artificial Sequence
  Description of Artificial Sequence: Synthetic peptide
RPHRINPQDDAVWPGYLWLG

SEQ ID NO: 1069 - protein, 20 aa, Artificial Sequence
  Description of Artificial Sequence: Synthetic peptide
HRGTVTGVWVARWPGYEWLS

SEQ ID NO: 1070 - protein, 20 aa, Artificial Sequence
  Description of Artificial Sequence: Synthetic peptide
FGRGYGGDGGGYWSGYEWLA

SEQ ID NO: 1071 - protein, 21 aa, Artificial Sequence
  Description of Artificial Sequence: Synthetic peptide
  MOD_RES (20): Unknown amino acid
DGLVVKSGREWPGYGWLERXA

SEQ ID NO: 1072 - protein, 20 aa, Artificial Sequence
  Description of Artificial Sequence: Synthetic peptide
  MOD_RES (6): Unknown amino acid
DGSIVXVSSSVGWPGYEWLM

SEQ ID NO: 1073 - protein, 20 aa, Artificial Sequence
  Description of Artificial Sequence: Synthetic peptide
WQQANLSNGGGRWGGYDWLM

SEQ ID NO: 1074 - protein, 20 aa, Artificial Sequence
  Description of Artificial Sequence: Synthetic peptide
FGRGYGGDGGGYWSGYEWLA

SEQ ID NO: 1075 - protein, 20 aa, Artificial Sequence
  Description of Artificial Sequence: Synthetic peptide
VNYEMDRVPPMPWGGYWWLS

SEQ ID NO: 1076 - protein, 20 aa, Artificial Sequence
  Description of Artificial Sequence: Synthetic peptide
MGGGLWVGVHIWPGYSWLSQ

SEQ ID NO: 1077 - protein, 20 aa, Artificial Sequence
  Description of Artificial Sequence: Synthetic peptide
SDVWAQPQRRNDWPGYHWLS

SEQ ID NO: 1078 - protein, 20 aa, Artificial Sequence
  Description of Artificial Sequence: Synthetic peptide
WPGYLFFEEALQDWRGSTED

SEQ ID NO: 1079 - protein, 20 aa, Artificial Sequence
  Description of Artificial Sequence: Synthetic peptide
SMFVAGSDRWPGYGVLADWL

SEQ ID NO: 1080 - protein, 20 aa, Artificial Sequence
  Description of Artificial Sequence: Synthetic peptide
VRGFQGGTVWPGYEWLRNAA

SEQ ID NO: 1081 - protein, 20 aa, Artificial Sequence
  Description of Artificial Sequence: Synthetic peptide
LDLASGDSWLGYDVLRGWLS

SEQ ID NO: 1082 - protein, 20 aa, Artificial Sequence
  Description of Artificial Sequence: Synthetic peptide
IHSSDGIGAWGGYAWFRDVA

SEQ ID NO: 1083 - protein, 20 aa, Artificial Sequence
  Description of Artificial Sequence: Synthetic peptide
LGPLLRWGSEVCGVWPDLCE

SEQ ID NO: 1084 - protein, 20 aa, Artificial Sequence
  Description of Artificial Sequence: Synthetic peptide
PFGFGGRWWGIPRMWWYRNS

SEQ ID NO: 1085 - protein, 20 aa, Artificial Sequence
  Description of Artificial Sequence: Synthetic peptide
WWWGGRNRWWLERWGLGGER

SEQ ID NO: 1086 - protein, 20 aa, Artificial Sequence
  Description of Artificial Sequence: Synthetic peptide
GRVALWGPVWPRWWFMSRPV

SEQ ID NO: 1087 - protein, 39 aa, Artificial Sequence
  Description of Artificial Sequence: Synthetic peptide
RGTRTDRLWKSGGFAIVPRWPCFSYHCLVEWITKTGSPG

SEQ ID NO: 1088 - protein, 32 aa, Artificial Sequence
  Description of Artificial Sequence: Synthetic peptide
GRTSMAFVPPRHLQPELAPRPVRNHAWLVGGG

SEQ ID NO: 1089 - protein, 20 aa, Artificial Sequence
  Description of Artificial Sequence: Synthetic peptide
CLGAGSFRAGILCLGGLPVS

SEQ ID NO: 1090 - protein, 20 aa, Artificial Sequence
  Description of Artificial Sequence: Synthetic peptide
GFWATACGGLQICEELGLKP

SEQ ID NO: 1091 - protein, 20 aa, Artificial Sequence
  Description of Artificial Sequence: Synthetic peptide
DLFCAYMAQALGLGQDLSCG

SEQ ID NO: 1092 - protein, 19 aa, Artificial Sequence
  Description of Artificial Sequence: Synthetic peptide
  MOD_RES (13): Unknown amino acid; translation read-through at TGA stop codon
RHLLLPQIWIASXGGWGMG

SEQ ID NO: 1093 - protein, 25 aa, Artificial Sequence
  Description of Artificial Sequence: Synthetic peptide
DHRLCGTDEYLMQDLFVRGLCRLIW

SEQ ID NO: 1094 - protein, 25 aa, Artificial Sequence
  Description of Artificial Sequence: Synthetic peptide
GLLFCKQLFTLAGLQPEAGCVSSSR

SEQ ID NO: 1095 - protein, 25 aa, Artificial Sequence
  Description of Artificial Sequence: Synthetic peptide
IWIACLDELLRGQVWSSCRRRAPIG

SEQ ID NO: 1096 - protein, 25 aa, Artificial Sequence
  Description of Artificial Sequence: Synthetic peptide
DWLRCLGVILSGGLTELANTGCVQG

SEQ ID NO: 1097 - protein, 25 aa, Artificial Sequence
  Description of Artificial Sequence: Synthetic peptide
WFSFCLGGLLQAQEWSVWGRDVGCI

SEQ ID NO: 1098 - protein, 25 aa, Artificial Sequence
  Description of Artificial Sequence: Synthetic peptide
GYSWLRDVLMEKQAQLKREGSVGRQ

SEQ ID NO: 1099 - protein, 25 aa, Artificial Sequence
  Description of Artificial Sequence: Synthetic peptide
  MOD_RES (13): Unknown amino acid; translation read-through at TGA stop codon
FLTRLLERLGLSXERGEAGGPYAQA

SEQ ID NO: 1100 - protein, 25 aa, Artificial Sequence
  Description of Artificial Sequence: Synthetic peptide
FSGFCMGLERLSQVSLGYCGAGQGG

SEQ ID NO: 1101 - protein, 25 aa, Artificial Sequence
  Description of Artificial Sequence: Synthetic peptide
ISFRCQLFVLAGMHPCPVDVGGEGF

SEQ ID NO: 1102 - protein, 25 aa, Artificial Sequence
  Description of Artificial Sequence: Synthetic peptide
NTPNCSQDWGQESGFMALLLALTCK

SEQ ID NO: 1103 - protein, 25 aa, Artificial Sequence
  Description of Artificial Sequence: Synthetic peptide
LQGFCELLATVTGVTGLGCLDYQPI

SEQ ID NO: 1104 - protein, 25 aa, Artificial Sequence
  Description of Artificial Sequence: Synthetic peptide
GSSICNLLARAQIVELALCEMGVQE

SEQ ID NO: 1105 - protein, 23 aa, Artificial Sequence
  Description of Artificial Sequence: Synthetic peptide
LSFACLLSQLSGVVLPDCLLGED

SEQ ID NO: 1106 - protein, 25 aa, Artificial Sequence
  Description of Artificial Sequence: Synthetic peptide
GEHFCQLLMSLCGDDCGPVNCGGGS

SEQ ID NO: 1107 - protein, 25 aa, Artificial Sequence
  Description of Artificial Sequence: Synthetic peptide
GWFECLLASLVLQVPQGRSRASAVC

SEQ ID NO: 1108 - protein, 25 aa, Artificial Sequence
  Description of Artificial Sequence: Synthetic peptide
YRQECACSVGAVGFLCGLACLARSG

SEQ ID NO: 1109 - protein, 40 aa, Artificial Sequence
  Description of Artificial Sequence: Synthetic peptide
LSCLAYSRHGIWRPSTDLGLGRSVGEGSVSTRWRGYDWFE

SEQ ID NO: 1110 - protein, 39 aa, Artificial Sequence
  Description of Artificial Sequence: Synthetic peptide
  MOD_RES (19): Unknown amino acid
GLDHSDAVGVHLGFAWPAXARGRWEAGGLEDTWAGYDWL

SEQ ID NO: 1111 - protein, 8 aa, Artificial Sequence
  Description of Artificial Sequence: Synthetic peptide
  MOD_RES (2): Unknown amino acid
WXGYAWLS

SEQ ID NO: 1112 - protein, 40 aa, Artificial Sequence; identical to SEQ ID NO: 1109
  Description of Artificial Sequence: Synthetic peptide

SEQ ID NO: 1113 - protein, 40 aa, Artificial Sequence
  Description of Artificial Sequence: Synthetic peptide
  MOD_RES (31): Unknown amino acid
EAMAVGLQCPARFVRAAAHGDGGSWGQDHVXAWGGYWWLG

SEQ ID NO: 1114 - protein, 20 aa, Artificial Sequence
  Description of Artificial Sequence: Synthetic peptide
HLCVLEELFWGASLFGYCSG

SEQ ID NO: 1115 - protein, 20 aa, Artificial Sequence
  Description of Artificial Sequence: Synthetic peptide
HFYVLVERLSGASLFGSGSA

SEQ ID NO: 1116 - protein, 20 aa, Artificial Sequence
  Description of Artificial Sequence: Synthetic peptide
HRFVREGLLWGAYQFCYCSG

SEQ ID NO: 1117 - protein, 20 aa, Artificial Sequence
  Description of Artificial Sequence: Synthetic peptide
FQSLLEELVWGAPLFRYGTG

SEQ ID NO: 1118 - protein, 20 aa, Artificial Sequence
  Description of Artificial Sequence: Synthetic peptide
HLSVLEELSWGASLFGQWAG

SEQ ID NO: 1119 - protein, 20 aa, Artificial Sequence
  Description of Artificial Sequence: Synthetic peptide
HLSVLEELSWGASLFGQWAG

SEQ ID NO: 1120 - protein, 20 aa, Artificial Sequence
  Description of Artificial Sequence: Synthetic peptide
NLCRLEELAWGASLFGQCAG

SEQ ID NO: 1121 - protein, 20 aa, Artificial Sequence
  Description of Artificial Sequence: Synthetic peptide
APVSTEELRWGALLFGQWAG

SEQ ID NO: 1122 - protein, 20 aa, Artificial Sequence
  Description of Artificial Sequence: Synthetic peptide
HLSVLEERWWRESLFGQWAG

SEQ ID NO: 1123 - protein, 20 aa, Artificial Sequence
  Description of Artificial Sequence: Synthetic peptide
HLSVLEERWWRAALFGQWAG

SEQ ID NO: 1124 - protein, 20 aa, Artificial Sequence
  Description of Artificial Sequence: Synthetic peptide
HLSILEEQWWRESLFGQWAG

SEQ ID NO: 1125 - protein, 19 aa, Artificial Sequence
  Description of Artificial Sequence: Synthetic peptide
HMSVEELSWWASLFGKQAG

SEQ ID NO: 1126 - protein, 20 aa, Artificial Sequence
  Description of Artificial Sequence: Synthetic peptide
HLSELEERWWRATLFGQWAG

SEQ ID NO: 1127 - protein, 20 aa, Artificial Sequence
  Description of Artificial Sequence: Synthetic peptide
HLSVLEELWWRESLFGQWAG

SEQ ID NO: 1128 - protein, 20 aa, Artificial Sequence
  Description of Artificial Sequence: Synthetic peptide
HLSLLEEQWWRESLFGQWAG

SEQ ID NO: 1129 - protein, 20 aa, Artificial Sequence
  Description of Artificial Sequence: Synthetic peptide
HLSVLEERWWRETLFGQWAG

SEQ ID NO: 1130 - protein, 20 aa, Artificial Sequence
  Description of Artificial Sequence: Synthetic peptide
HLSVLEEQWWRESLFGQWAG

SEQ ID NO: 1131 - protein, 20 aa, Artificial Sequence
  Description of Artificial Sequence: Synthetic peptide
  MOD_RES (11): Unknown amino acid
HLSVLEEQWWXESLFGQWAG

SEQ ID NO: 1132 - protein, 20 aa, Artificial Sequence
  Description of Artificial Sequence: Synthetic peptide
HLSVLEELWWREALFGQWAG

SEQ ID NO: 1133 - protein, 20 aa, Artificial Sequence
  Description of Artificial Sequence: Synthetic peptide
HLSVLEERWWRATLFGEWAG

SEQ ID NO: 1134 - protein, 20 aa, Artificial Sequence
  Description of Artificial Sequence: Synthetic peptide
  MOD_RES (3): Unknown amino acid
HLXVLEELLWGVSLFRQWAG

SEQ ID NO: 1135 - protein, 20 aa, Artificial Sequence
  Description of Artificial Sequence: Synthetic peptide
HLSALEEQWWRATLFGQWAG

SEQ ID NO: 1136 - protein, 19 aa, Artificial Sequence
  Description of Artificial Sequence: Synthetic peptide
HLSVLEERWWRATLLESGQ

SEQ ID NO: 1137 - protein, 20 aa, Artificial Sequence
  Description of Artificial Sequence: Synthetic peptide
HLSALEELWWRETLFGQWAG

SEQ ID NO: 1138 - protein, 20 aa, Artificial Sequence
  Description of Artificial Sequence: Synthetic peptide
HLSVLEELWWRESLFGKWAG

SEQ ID NO: 1139 - protein, 20 aa, Artificial Sequence
  Description of Artificial Sequence: Synthetic peptide
HLSVLEEAWWRESLFGHWAG

SEQ ID NO: 1140 - protein, 20 aa, Artificial Sequence
  Description of Artificial Sequence: Synthetic peptide
HMSEQEELWWRATLFGQWAG

SEQ ID NO: 1141 - protein, 20 aa, Artificial Sequence
  Description of Artificial Sequence: Synthetic peptide
HLSVLEERWWRETLFGEWAG

SEQ ID NO: 1142 - protein, 20 aa, Artificial Sequence
  Description of Artificial Sequence: Synthetic peptide
HRSVLKQLSWGASLFGQWAG

SEQ ID NO: 1143 - protein, 20 aa, Artificial Sequence
  Description of Artificial Sequence: Synthetic peptide
  MOD_RES (3): Unknown amino acid; translation read-through at TGA stop codon
HLXVLEELSWGASLVGQWAV

SEQ ID NO: 1144 - protein, 20 aa, Artificial Sequence
  Description of Artificial Sequence: Synthetic peptide
  MOD_RES (9): Unknown amino acid; translation read-through at TGA stop codon
HLSVLEELXLGASMFGLWAG

SEQ ID NO: 1145 - protein, 20 aa, Artificial Sequence
  Description of Artificial Sequence: Synthetic peptide
  MOD_RES (11): Unknown amino acid; translation read-through at TGA stop codon
HLSVLKELSWXASLFGQWAG

SEQ ID NO: 1146 - protein, 20 aa, Artificial Sequence
  Description of Artificial Sequence: Synthetic peptide
HLSALEELSWGASLFGQWAG

SEQ ID NO: 1147 - protein, 20 aa, Artificial Sequence
  Description of Artificial Sequence: Synthetic peptide
  MOD_RES (10): Unknown amino acid; translation read-through at TGA stop codon
HLSVLAELSXGALLFGQWAG

SEQ ID NO: 1148 - protein, 20 aa, Artificial Sequence
  Description of Artificial Sequence: Synthetic peptide
RLSVLEQLSWGASLFGPWAG

SEQ ID NO: 1149 - protein, 20 aa, Artificial Sequence
  Description of Artificial Sequence: Synthetic peptide
  MOD_RES (3): Unknown amino acid; translation read-through at TGA stop codon
HLXVLVQPSWGASLFGQWAG

SEQ ID NO: 1150 - protein, 20 aa, Artificial Sequence
  Description of Artificial Sequence: Synthetic peptide
  MOD_RES (11): Unknown amino acid; translation read-through at TGA stop codon
HQSVLEELSRXASLFGQWAG

SEQ ID NO: 1151 - protein, 20 aa, Artificial Sequence
  Description of Artificial Sequence: Synthetic peptide
  MOD_RES (13): Unknown amino acid; translation read-through at TGA stop codon
DMSVLGGLSWGAXLFGQWSG

SEQ ID NO: 1152 - protein, 20 aa, Artificial Sequence
  Description of Artificial Sequence: Synthetic peptide
HLSVREGQLWRASMFGRWAG

SEQ ID NO: 1153 - protein, 20 aa, Artificial Sequence
  Description of Artificial Sequence: Synthetic peptide
  MOD_RES (9): Unknown amino acid; translation read-through at TGA stop codon
QLSVLVELXWGASLFGPWAA

SEQ ID NO: 1154 - protein, 20 aa, Artificial Sequence
  Description of Artificial Sequence: Synthetic peptide
  MOD_RES (11): Unknown amino acid; translation read-through at TGA stop codon
HLSVGEELSWXVALLGQWAR

SEQ ID NO: 1155 - protein, 24 aa, Artificial Sequence
  Description of Artificial Sequence: Synthetic peptide
KIGGQGQHQDGNFYDWFVEALAKK

SEQ ID NO: 1156 - protein, 23 aa, Artificial Sequence
  Description of Artificial Sequence: Synthetic peptide
KVLQARHGCDSVSDCFYEWFAKK

SEQ ID NO: 1157 - protein, 23 aa, Artificial Sequence
  Description of Artificial Sequence: Synthetic peptide
KWSALLSVMDTGFYAWFDDAVKK

SEQ ID NO: 1158 - protein, 23 aa, Artificial Sequence
  Description of Artificial Sequence: Synthetic peptide
KGHSWALVRHVDRLFYEWFDLKK

SEQ ID NO: 1159 - protein, 23 aa, Artificial Sequence
  Description of Artificial Sequence: Synthetic peptide
KRDKPTDQEEQNWSFYEWFRHKK

SEQ ID NO: 1160 - protein, 24 aa, Artificial Sequence
  Description of Artificial Sequence: Synthetic peptide
KVFWNCRSQQLDFYEWWFEQAAKK

SEQ ID NO: 1161 - protein, 24 aa, Artificial Sequence
  Description of Artificial Sequence: Synthetic peptide
KLESHYVVPQAALDRLFYSWFSKK

SEQ ID NO: 1162 - protein, 23 aa, Artificial Sequence
  Description of Artificial Sequence: Synthetic peptide
KFYGWFSRQLSLTPRDDWGLPKK

SEQ ID NO: 1163 - protein, 23 aa, Artificial Sequence
  Description of Artificial Sequence: Synthetic peptide
KSAPGLVSNKQDGLFYSWFREKK

SEQ ID NO: 1164 - protein, 23 aa, Artificial Sequence
  Description of Artificial Sequence: Synthetic peptide
KRGGGTFYEWFESALRKHGAGKK

SEQ ID NO: 1165 - protein, 23 aa, Artificial Sequence
  Description of Artificial Sequence: Synthetic peptide
KDPERMQSDVGFYEWFRAAVGKK

SEQ ID NO: 1166 - protein, 27 aa, Artificial Sequence
  Description of Artificial Sequence: Synthetic peptide
DYKDCWARPCGDAANFYDWFVQQASKK

SEQ ID NO: 1167 - protein, 27 aa, Artificial Sequence
  Description of Artificial Sequence: Synthetic peptide
DYKDVTFTSAVFHENFYDWFVRQVSKK

SEQ ID NO: 1168 - protein, 12 aa, Artificial Sequence
  Description of Artificial Sequence: Synthetic peptide
SAKNFYDWFVKK

SEQ ID NO: 1169 - protein, 14 aa, Artificial Sequence
  Description of Artificial Sequence: Synthetic peptide
ADKNFYDWFMAAKK

SEQ ID NO: 1170 - protein, 23 aa, Artificial Sequence
  Description of Artificial Sequence: Synthetic peptide
DYKDLCQSWGVRIGWLAGLCPKK

SEQ ID NO: 1171 - protein, 16 aa, Artificial Sequence
  Description of Artificial Sequence: Synthetic peptide
FHENFYDWFVRQVSKK

SEQ ID NO: 1172 - protein, 26 aa, Artificial Sequence
  Description of Artificial Sequence: Synthetic peptide
DYKDFYDAIDQLVRGSARAGGTRDKK

SEQ ID NO: 1173 - protein, 23 aa, Artificial Sequence
  Description of Artificial Sequence: Synthetic peptide
KDRAFYNGLRDLVGAVYGAWDKK

SEQ ID NO: 1174 - protein, 23 aa, Artificial Sequence
  Description of Artificial Sequence: Synthetic peptide
KVRGFQGGTVWPGYEWLRNAAKK

SEQ ID NO: 1175 - protein, 23 aa, Artificial Sequence
  Description of Artificial Sequence: Synthetic peptide
KSMFVAGSDRWPGYGVLADWLKK

SEQ ID NO: 1176 - protein, 23 aa, Artificial Sequence
  Description of Artificial Sequence: Synthetic peptide
KEIEAEWGRVRCLVYGRCVGGKK

SEQ ID NO: 1177 - protein, 23 aa, Artificial Sequence
  Description of Artificial Sequence: Synthetic peptide
KWLDQEWAWVQCEVYGRGCPSKK

SEQ ID NO: 1178 - protein, 23 aa, Artificial Sequence
  Description of Artificial Sequence: Synthetic peptide
KHLCVLEELFWGASLFGYCSGKK

SEQ ID NO: 1179 - protein, 26 aa, Artificial Sequence
  Description of Artificial Sequence: Synthetic peptide
DYKDERSAAGFRGNFYDWFVAQVNKK

SEQ ID NO: 1180 - protein, 16 aa, Artificial Sequence
  Description of Artificial Sequence: Synthetic peptide
LGENFYDWFVMQVRKK

SEQ ID NO: 1181 - protein, 26 aa, Artificial Sequence
  Description of Artificial Sequence: Synthetic peptide
DYKDFYDAIDQLVRGSARAGGTRDKK

SEQ ID NO: 1182 - protein, 27 aa, Artificial Sequence
  Description of Artificial Sequence: Synthetic peptide
DYKDCWARPCGDAANFYDWFVQQASKK

SEQ ID NO: 1183 - protein, 23 aa, Artificial Sequence
  Description of Artificial Sequence: Synthetic peptide
KWLDQEWAWVQCEVYGRGCPSKK

SEQ ID NO: 1184 - protein, 19 aa, Artificial Sequence
  Description of Artificial Sequence: Synthetic peptide
KRGFQGGTVWPGYEWLRNA

SEQ ID NO: 1185 - protein, 23 aa, Artificial Sequence
  Description of Artificial Sequence: Synthetic peptide
KHLCVLEELFWGASLFGYCSGKK

SEQ ID NO: 1186 - protein, 16 aa, Artificial Sequence
  Description of Artificial Sequence: Synthetic peptide
FHENFYDWFVRQVSKK

SEQ ID NO: 1187 - protein, 20 aa, Artificial Sequence
  Description of Artificial Sequence: Synthetic peptide
RLYYEWFWGQLEAQGRGGLS

SEQ ID NO: 1188 - protein, 20 aa, Artificial Sequence
  Description of Artificial Sequence: Synthetic peptide
GLEQGCPWVGLEVQCRGCPS

SEQ ID NO: 1189 - protein, 20 aa, Artificial Sequence
  Description of Artificial Sequence: Synthetic peptide
FYCGLEELSWGAALFGYCSG

SEQ ID NO: 1190 - protein, 20 aa, Artificial Sequence
  Description of Artificial Sequence: Synthetic peptide
GNGDGMFYQLLSLLVGRDMH

SEQ ID NO: 1191 - protein, 26 aa, Artificial Sequence
  Description of Artificial Sequence: Synthetic peptide
GIISQSCPESFYDWFAGQVSDPWWCW

SEQ ID NO: 1192 - protein, 21 aa, Artificial Sequence
  Description of Artificial Sequence: Synthetic peptide
VEGRGLFYDLLRQLLARRQNG

SEQ ID NO: 1193 - protein, 19 aa, Artificial Sequence
  Description of Artificial Sequence: Synthetic peptide
RAMSFYDALVSVLGLGPKK

SEQ ID NO: 1194 - protein, 20 aa, Artificial Sequence
  Description of Artificial Sequence: Synthetic peptide
GSRPVFHEQFYEWFVDQLGL

SEQ ID NO: 1195 - protein, 20 aa, Artificial Sequence
  Description of Artificial Sequence: Synthetic peptide
RSEASFHVEFYSWFEEQLRS

SEQ ID NO: 1196 - protein, 20 aa, Artificial Sequence
  Description of Artificial Sequence: Synthetic peptide
GRFYGWFQDAIDQLMPWGFD

SEQ ID NO: 1197 - protein, 19 aa, Artificial Sequence
  Description of Artificial Sequence: Synthetic peptide
PPWGARFYDAIEQLVFDNL

SEQ ID NO: 1198 - protein, 23 aa, Artificial Sequence
  Description of Artificial Sequence: Synthetic peptide
AGVNAGFYRYFSTLLDWWDQGKK

SEQ ID NO: 1199 - protein, 27 aa, Artificial Sequence
  Description of Artificial Sequence: Synthetic peptide
TFYSCLASLLTGTPQPNRGPWERCRKK

SEQ ID NO: 1200 - protein, 17 aa, Artificial Sequence
  Description of Artificial Sequence: Synthetic peptide
AAVHEQFYDWFADQYKK

SEQ ID NO: 1201 - protein, 17 aa, Artificial Sequence
  Description of Artificial Sequence: Synthetic peptide
QSFYDYIEELLGGEWKK

SEQ ID NO: 1202 - protein, 17 aa, Artificial Sequence
  Description of Artificial Sequence: Synthetic peptide
QSFYDYIEELLGGEWEE

SEQ ID NO: 1203 - protein, 18 aa, Artificial Sequence
  Description of Artificial Sequence: Synthetic peptide
GSLDESFYDWFERQLGKK

SEQ ID NO: 1204 - protein, 18 aa, Artificial Sequence
  Description of Artificial Sequence: Synthetic peptide
GSFYEALQRLVGGEQGKK

SEQ ID NO: 1205 - protein, 17 aa, Artificial Sequence
  Description of Artificial Sequence: Synthetic peptide
QAPSNFYDWFVREWDKK

SEQ ID NO: 1206 - protein, 17 aa, Artificial Sequence
  Description of Artificial Sequence: Synthetic peptide
DPFYQGLWEWLRESGKK

SEQ ID NO: 1207 - protein, 20 aa, Artificial Sequence
  Description of Artificial Sequence: Synthetic peptide
ASGFPENFYDWFGRQLSLKK

SEQ ID NO: 1208 - protein, 20 aa, Artificial Sequence
  Description of Artificial Sequence: Synthetic peptide
SACQFDCHENFYDWFARQKK

SEQ ID NO: 1209 - protein, 20 aa, Artificial Sequence
  Description of Artificial Sequence: Synthetic peptide
SQAGSAFYAWFDQVLRTVKK

SEQ ID NO: 1210 - protein, 20 aa, Artificial Sequence
  Description of Artificial Sequence: Synthetic peptide
VMDARDDPFYHKLSELVTKK

SEQ ID NO: 1211 - protein, 20 aa, Artificial Sequence
  Description of Artificial Sequence: Synthetic peptide
QSDAFYSGLWALIGLSDGKK

SEQ ID NO: 1212 - protein, 19 aa, Artificial Sequence
  Description of Artificial Sequence: Synthetic peptide
LQPCSGFYECIERLIGVKK

SEQ ID NO: 1213 - protein, 19 aa, Artificial Sequence
  Description of Artificial Sequence: Synthetic peptide
LKDGFYDYFWQRLHLGSKK

SEQ ID NO: 1214 - protein, 19 aa, Artificial Sequence
  Description of Artificial Sequence: Synthetic peptide
GSASFYDAIDRLLRMRIKK

SEQ ID NO: 1215 - protein, 20 aa, Artificial Sequence
  Description of Artificial Sequence: Synthetic peptide
WPGYLFFEEALQDWRGSTED

SEQ ID NO: 1216 - protein, 9 aa, Artificial Sequence
  Description of Artificial Sequence: Synthetic peptide
AFYDWFAKK

SEQ ID NO: 1217 - protein, 17 aa, Artificial Sequence
  Description of Artificial Sequence: Synthetic peptide
LDALDRLMRYFEERPSL

SEQ ID NO: 1218 - protein, 20 aa, Artificial Sequence
  Description of Artificial Sequence: Synthetic peptide
PLAELWAYFEHSEQGRSSAH

SEQ ID NO: 1219 - protein, 21 aa, Artificial Sequence
  Description of Artificial Sequence: Synthetic peptide
GRVDWLQRNANFYDWFVAELG

SEQ ID NO: 1220 - protein, 21 aa, Artificial Sequence
  Description of Artificial Sequence: Synthetic peptide
NGVERAGTGDNFYDWFVAQLH

SEQ ID NO: 1221 - protein, 21 aa, Artificial Sequence
  Description of Artificial Sequence: Synthetic peptide
IGGQGQHQDGNFYDWFVEALA

SEQ ID NO: 1222 - protein, 20 aa, Artificial Sequence
  Description of Artificial Sequence: Synthetic peptide
VFWNCRSQQLDFYEWFEQAA

SEQ ID NO: 1223 - protein, 20 aa, Artificial Sequence
  Description of Artificial Sequence: Synthetic peptide
RGGGTFYEWFESALRKHGAG

SEQ ID NO: 1224 - protein, 26 aa, Artificial Sequence
  Description of Artificial Sequence: Synthetic peptide
RVAGAISAPGLVSNKQDGLFYSWFRE

SEQ ID NO: 1225 - protein, 20 aa, Artificial Sequence
  Description of Artificial Sequence: Synthetic peptide
VLQARHGCDSVSDCFYEWFA

SEQ ID NO: 1226 - protein, 20 aa, Artificial Sequence
  Description of Artificial Sequence: Synthetic peptide
DPERMQSDVGFYEWFRAAVG

SEQ ID NO: 1227 - protein, 20 aa, Artificial Sequence
  Description of Artificial Sequence: Synthetic peptide
WSALLSVMDTGFYAWFDDAV

SEQ ID NO: 1228 - protein, 20 aa, Artificial Sequence
  Description of Artificial Sequence: Synthetic peptide
DIGSDGHGRRWDSFYRWFEM

SEQ ID NO: 1229 - protein, 16 aa, Artificial Sequence
  Description of Artificial Sequence: Synthetic peptide
IGGSFVEFYGWFNDQV

SEQ ID NO: 1230 - protein, 20 aa, Artificial Sequence
  Description of Artificial Sequence: Synthetic peptide
GHSWALVRHVDRLFYEWFDL

SEQ ID NO: 1231 - protein, 20 aa, Artificial Sequence
  Description of Artificial Sequence: Synthetic peptide
LPAGGAQGFAVRGFYEWFES

SEQ ID NO: 1232 - protein, 20 aa, Artificial Sequence
  Description of Artificial Sequence: Synthetic peptide
RDKPTDQEEQNWSFYEWFRH

SEQ ID NO: 1233 - protein, 20 aa, Artificial Sequence
  Description of Artificial Sequence: Synthetic peptide
SRDQTNFTFNSAGFYGWFER

SEQ ID NO: 1234 - protein, 20 aa, Artificial Sequence
  Description of Artificial Sequence: Synthetic peptide
GAFYRWFHEALVGSERVPDV

SEQ ID NO: 1235 - protein, 20 aa, Artificial Sequence
  Description of Artificial Sequence: Synthetic peptide
RIGGGWARSEGFYEWFVREL

SEQ ID NO: 1236 - protein, 20 aa, Artificial Sequence
  Description of Artificial Sequence: Synthetic peptide
RMFYEWFWSQMGAGPTEGSA

SEQ ID NO: 1237 - protein, 20 aa, Artificial Sequence
  Description of Artificial Sequence: Synthetic peptide
HEAFYDWFSALVDGGYELMG

SEQ ID NO: 1238 - protein, 20 aa, Artificial Sequence
  Description of Artificial Sequence: Synthetic peptide
FYGWFSRQLSLTPRDDWGLP

SEQ ID NO: 1239 - protein, 17 aa, Artificial Sequence
  Description of Artificial Sequence: Synthetic peptide
GVGTLTMSSDAFYTWFV

SEQ ID NO: 1240 - protein, 20 aa, Artificial Sequence
  Description of Artificial Sequence: Synthetic peptide
LGTSAGQGVGHRAFYQWFQS

SEQ ID NO: 1241 - protein, 23 aa, Artificial Sequence
  Description of Artificial Sequence: Synthetic peptide
ETLESHYVVPQAALDRLFYSWFS

SEQ ID NO: 1242 - protein, 40 aa, Artificial Sequence; identical to SEQ ID NO: 1
  Description of Artificial Sequence: Synthetic peptide

SEQ ID NO: 1243 - protein, 40 aa, Artificial Sequence; identical to SEQ ID NO: 2
  Description of Artificial Sequence: Synthetic peptide

SEQ ID NO: 1244 - protein, 20 aa, Artificial Sequence
  Description of Artificial Sequence: Synthetic peptide
EIEAEWGRVRCLVYGRCVGG

SEQ ID NO: 1245 - protein, 20 aa, Artificial Sequence
  Description of Artificial Sequence: Synthetic peptide
WLDQEWAWVQCEVYGRGCPS

SEQ ID NO: 1246 - protein, 24 aa, Artificial Sequence
  Description of Artificial Sequence: Synthetic peptide
DYKDFYDAIDQLVRGSARAGGTRD

SEQ ID NO: 1247 - protein, 24 aa, Artificial Sequence
  Description of Artificial Sequence: Synthetic peptide
DYKDDRAFYNGLRDLVGAVYGAWD

SEQ ID NO: 1248 - protein, 24 aa, Artificial Sequence
  Description of Artificial Sequence: Synthetic peptide
DYKDRLFYCGIQALGANLGYSGCV

SEQ ID NO: 1249 - protein, 19 aa, Artificial Sequence
  Description of Artificial Sequence: Synthetic peptide
DYKDFYSALWGLCGVTGCG

SEQ ID NO: 1250 - protein, 20 aa, Artificial Sequence
  Description of Artificial Sequence: Synthetic peptide
RGQSDAFYSGLWALIGLSDG

SEQ ID NO: 1251 - protein, 41 aa, Artificial Sequence
  Description of Artificial Sequence: Synthetic peptide
RYFPFGGFYGNLDVLRWLRPYVASPRWGHWRPGGSLGKQPT

SEQ ID NO: 1252 - protein, 20 aa, Artificial Sequence
  Description of Artificial Sequence: Synthetic peptide
PFGFGGRWWGIPRMWWYRNS

SEQ ID NO: 1253 - protein, 20 aa, Artificial Sequence
  Description of Artificial Sequence: Synthetic peptide
WWWGGRNRWWLERWGLGGER

SEQ ID NO: 1254 - protein, 20 aa, Artificial Sequence
  Description of Artificial Sequence: Synthetic peptide
LGPLLRWGSEVCGVWPDLCE

SEQ ID NO: 1255 - protein, 20 aa, Artificial Sequence
  Description of Artificial Sequence: Synthetic peptide
GRVALWGPVWPRWWFMSRPV

SEQ ID NO: 1256 - protein, 20 aa, Artificial Sequence
  Description of Artificial Sequence: Synthetic peptide
SMFVAGSDRWPGYGVLADWL

SEQ ID NO: 1257 - protein, 20 aa, Artificial Sequence
  Description of Artificial Sequence: Synthetic peptide
VRGFQGGTVWPGYEWLRNAA

SEQ ID NO: 1258 - protein, 20 aa, Artificial Sequence
  Description of Artificial Sequence: Synthetic peptide
WPGYLFFEEALQDWRGSTED

SEQ ID NO: 1259 - protein, 20 aa, Artificial Sequence
  Description of Artificial Sequence: Synthetic peptide
ACSSFFVKGPEGFLQCLGSI

SEQ ID NO: 1260 - protein, 20 aa, Artificial Sequence
  Description of Artificial Sequence: Synthetic peptide
HLCVLEELFWGASLFGYCSG

SEQ ID NO: 1261 - protein, 36 aa, Artificial Sequence
  Description of Artificial Sequence: Synthetic peptide
PERGRGLRTAMQLMRRPRDWHFPHSLFWGAPPPLSG

SEQ ID NO: 1262 - protein, 36 aa, Artificial Sequence
  Description of Artificial Sequence: Synthetic peptide
PAMAVGYPQPCAKSTYERGRGSALESRCYQAAAGAP

SEQ ID NO: 1263 - protein, 36 aa, Artificial Sequence
  Description of Artificial Sequence: Synthetic peptide
  MOD_RES (9): Unknown amino acid; translation read-through at TGA stop codon
PAMACKVCXCCSVSCYDGFPRSGAHPGRRWAAAGAP

SEQ ID NO: 1264 - protein, 36 aa, Artificial Sequence
  Description of Artificial Sequence: Synthetic peptide
PAMAFKVSLSCGESFYEWFAGLVRDPTCGWTAAGAP

SEQ ID NO: 1265 - protein, 33 aa, Artificial Sequence
  Description of Artificial Sequence: Synthetic peptide
  MOD_RES (14): Unknown amino acid; translation read-through at TGA stop codon
AGHGACEFQVMFGXLVHLLGFPGRLGKGLAAGA

SEQ ID NO: 1266 - protein, 36 aa, Artificial Sequence
  Description of Artificial Sequence: Synthetic peptide
  MOD_RES (29): Unknown amino acid; translation read-through at TGA stop codon
RPWRGSWLRLVGRRVECYCAERGATRGWXCAAAGAP

SEQ ID NO: 1267 - protein, 36 aa, Artificial Sequence
  Description of Artificial Sequence: Synthetic peptide
AGHGDFGALSCKAAVVAWVPVQTAGLRVRVAAAGAP

SEQ ID NO: 1268 - protein, 36 aa, Artificial Sequence
  Description of Artificial Sequence: Synthetic peptide
PAMAPRLYQGCPESFYAWTAGHVSPALYGWAAAGAP

SEQ ID NO: 1269 - protein, 36 aa, Artificial Sequence
  Description of Artificial Sequence: Synthetic peptide
  MOD_RES (22): Unknown amino acid; translation read-through at TAA stop codon
PGHGVSVRAGVSGMLRREVAGXCVSAWEGLCGRRCA

SEQ ID NO: 1270 - protein, 36 aa, Artificial Sequence
  Description of Artificial Sequence: Synthetic peptide
  MOD_RES (10): Unknown amino acid; translation read-through at TAA stop codon
  MOD_RES (24): Unknown amino acid; translation read-through at TAA stop codon
  MOD_RES (30): Unknown amino acid; translation read-through at TAA stop codon
PAMAGMDPQXCTVASSRWFASPVXVVWRCXAAAGAP

SEQ ID NO: 1271 - protein, 36 aa, Artificial Sequence
  Description of Artificial Sequence: Synthetic peptide
PAMAGMFSQTCPEGFYGWFAGQASDSSLCRAAAGAP

SEQ ID NO: 1272 - protein, 36 aa, Artificial Sequence
  Description of Artificial Sequence: Synthetic peptide
  MOD_RES (16): Unknown amino acid; translation read-through at TGA stop codon
  MOD_RES (27): Unknown amino acid; translation read-through at TAA stop codon
PAMAPLGFRSCAGAYXVGCGRRVAFEXRCWAAAGAP

SEQ ID NO: 1273 - protein, 36 aa, Artificial Sequence
  Description of Artificial Sequence: Synthetic peptide
  MOD_RES (19): Unknown amino acid; translation read-through at TAA stop codon
PAMAGILCPSCPHFLVDSXAAQDAAGQWPSAAAGAP

SEQ ID NO: 1274 - protein, 36 aa, Artificial Sequence
  Description of Artificial Sequence: Synthetic peptide
PAMARRIPRECGDSFYVGLRWLVENPRSDWAAAGAP

SEQ ID NO: 1275 - protein, 36 aa, Artificial Sequence
  Description of Artificial Sequence: Synthetic peptide
PAMADRIGVQCPDSFYGWFAVQEPGTSGGLAAAGAP

SEQ ID NO: 1276 - protein, 31 aa, Artificial Sequence
  Description of Artificial Sequence: Synthetic peptide
  MOD_RES (9): Unknown amino acid; translation read-through at TGA stop codon
PAMAGLPSXSCRVAMYKGQAAWSCSAAAGAP

SEQ ID NO: 1277 - protein, 35 aa, Artificial Sequence
  Description of Artificial Sequence: Synthetic peptide
RPWRLILVTLVREASMTGSGVWYPRRGGAGPAEGA

SEQ ID NO: 1278 - protein, 36 aa, Artificial Sequence
  Description of Artificial Sequence: Synthetic peptide
  MOD_RES (22): Unknown amino acid; translation read-through at TGA stop codon
  MOD_RES (29): Unknown amino acid; translation read-through at TAA stop codon
PAMAGSARQVCVDGVVGWREGXVVDQWLXRAAAGAP

SEQ ID NO: 1279 - protein, 36 aa, Artificial Sequence
  Description of Artificial Sequence: Synthetic peptide
PAMAGIMQRACEGGFTDCLWSLISGASSGRAAAGAP

SEQ ID NO: 1280 - protein, 36 aa, Artificial Sequence
  Description of Artificial Sequence: Synthetic peptide
RPWRVSSLRHVRVTCGELFGGQVSELFCLCAAAGAP

SEQ ID NO: 1281 - protein, 36 aa, Artificial Sequence
  Description of Artificial Sequence: Synthetic peptide
  MOD_RES (28): Unknown amino acid; translation read-through at TAA stop codon
PAMAGLIYMSCLAYFDDLIERRLEKPGXRFAAAGAP

SEQ ID NO: 1282 - protein, 36 aa, Artificial Sequence
  Description of Artificial Sequence: Synthetic peptide
PAMAGIMPQSCGETSGKCMRGQVSLRWRWSAAAGAP

SEQ ID NO: 1283 - protein, 36 aa, Artificial Sequence
  Description of Artificial Sequence: Synthetic peptide
PAMAFILPRSCEDYLYDFLASKVVHVFRSLAAAGAP

SEQ ID NO: 1284 - protein, 35 aa, Artificial Sequence
  Description of Artificial Sequence: Synthetic peptide
PAMACMSSQPCGESFYDWFAGQVRDPGWESAAAGA

SEQ ID NO: 1285 - protein, 35 aa, Artificial Sequence
  Description of Artificial Sequence: Synthetic peptide
  MOD_RES (16): Unknown amino acid; translation read-through at TGA stop codon
  MOD_RES (30): Unknown amino acid; translation read-through at TAA stop codon
RPWRGWAIRGVRHRCXGAWRGQVAQELCRXAAAGA

SEQ ID NO: 1286 - protein, 36 aa, Artificial Sequence
  Description of Artificial Sequence: Synthetic peptide
PAMAGIASHTCPGGFYEWFACQSRAPGWDGAAAGAP

SEQ ID NO: 1287 - protein, 36 aa, Artificial Sequence
  Description of Artificial Sequence: Synthetic peptide
PAMAGRIARACPDSMFGWLAGQGSQQSGWQAAAGAP

SEQ ID NO: 1288 - protein, 36 aa, Artificial Sequence
  Description of Artificial Sequence: Synthetic peptide
  MOD_RES (12): Unknown amino acid; translation read-through at TAA stop codon
PAMARPISPLCXRRSKDEDASRVSLPGFFCAAAGAP

SEQ ID NO: 1289 - protein, 43 aa, Artificial Sequence
  Description of Artificial Sequence: Synthetic peptide
PAMADYKDDDDKTFYACLASLMAGTPRQYRTPWARCPAAAGAP

SEQ ID NO: 1290 - protein, 36 aa, Artificial Sequence
  Description of Artificial Sequence: Synthetic peptide
  MOD_RES (13): Unknown amino acid; translation read-through at TAA stop codon
  MOD_RES (29): Unknown amino acid; translation read-through at TGA stop codon
RPWRVNTSESCLXFVCSLFSGYECWVGGXWAAAGAP

SEQ ID NO: 1291 - protein, 36 aa, Artificial Sequence
  Description of Artificial Sequence: Synthetic peptide
PAMAGMGVQSCHDSFYGWFGCLFSDAEGDRAAAGAP

SEQ ID NO: 1292 - protein, 36 aa, Artificial Sequence
  Description of Artificial Sequence: Synthetic peptide
  MOD_RES (18): Unknown amino acid
PAMAGDTSRACPESLNGXFCVVGVALRRWIAAAGAP

SEQ ID NO: 1293 - protein, 36 aa, Artificial Sequence
  Description of Artificial Sequence: Synthetic peptide
PAMARWWRGLCGERWYHRGWVQVQFPWERGAAAGAP

SEQ ID NO: 1294 - protein, 34 aa, Artificial Sequence
  Description of Artificial Sequence: Synthetic peptide
RPWRVPWVLEMPEYGNANLVFYDALQRLAAAGAP

SEQ ID NO: 1295 - protein, 36 aa, Artificial Sequence
  Description of Artificial Sequence: Synthetic peptide
AGHGVCYLAGVFGEALGGGRVSGFAIGQVRAAAGAP

SEQ ID NO: 1296 - protein, 36 aa, Artificial Sequence
  Description of Artificial Sequence: Synthetic peptide
PAMAGRIKEFCSRSFYDQVACLVKGPSWGGAAAGAP

SEQ ID NO: 1297 - protein, 36 aa, Artificial Sequence; identical to SEQ ID NO: 1296
  Description of Artificial Sequence: Synthetic peptide

SEQ ID NO: 1298 - protein, 36 aa, Artificial Sequence
  Description of Artificial Sequence: Synthetic peptide
PAMAGISSRSCAENLRFGRAWQGSDVWDCLAAAGAP

SEQ ID NO: 1299 - protein, 36 aa, Artificial Sequence
  Description of Artificial Sequence: Synthetic peptide
PAMASRIPQWCRDSFYEWFECQLLGPRESRAAAGAP

SEQ ID NO: 1300 - protein, 36 aa, Artificial Sequence
  Description of Artificial Sequence: Synthetic peptide
PAMAGAESCYRAKSFYDGLGCLVGEAWWGGAAAGAP

SEQ ID NO: 1301 - protein, 36 aa, Artificial Sequence
  Description of Artificial Sequence: Synthetic peptide
PAMARSGAPRCHDPFYEWFAVEAQEPLRCEAAAGAP

SEQ ID NO: 1302 - protein, 36 aa, Artificial Sequence; identical to SEQ ID NO: 1291
  Description of Artificial Sequence: Synthetic peptide

SEQ ID NO: 1303 - protein, 36 aa, Artificial Sequence
  Description of Artificial Sequence: Synthetic peptide
PAMADISFESCLAQLLGWRAGEGSKRLWRCAAAGAP

SEQ ID NO: 1304 - protein, 36 aa, Artificial Sequence
  Description of Artificial Sequence: Synthetic peptide
PAMANTFLYPCRDPFYHSLADLVGVAMQCGAAAGAP

SEQ ID NO: 1305 - protein, 36 aa, Artificial Sequence
  Description of Artificial Sequence: Synthetic peptide
PAMARRIPRECGDSFYAGLRCLVESPRSDWAAAGAP

SEQ ID NO: 1306 - protein, 36 aa, Artificial Sequence
  Description of Artificial Sequence: Synthetic peptide
PAMASIVCPFCEDSFYNWFAAQVADTRGLWAAAGAP

SEQ ID NO: 1307 - protein, 36 aa, Artificial Sequence
  Description of Artificial Sequence: Synthetic peptide
PAMAWSHSHAYTESYYDWFAAQVLSAGSGRAAAGAP

SEQ ID NO: 1308 - protein, 36 aa, Artificial Sequence; identical to SEQ ID NO: 1296
  Description of Artificial Sequence: Synthetic peptide

SEQ ID NO: 1309 - protein, 36 aa, Artificial Sequence
  Description of Artificial Sequence: Synthetic peptide
PAMARSRPPACGDSFYGWFECEVSGLGRRGAAAGAP

SEQ ID NO: 1310 - protein, 36 aa, Artificial Sequence
  Description of Artificial Sequence: Synthetic peptide
PAMAGISYPACEESFYDCLASLVLSPWGSGAAAGAP

SEQ ID NO: 1311 - protein, 36 aa, Artificial Sequence; identical to SEQ ID NO: 1296
  Description of Artificial Sequence: Synthetic peptide

SEQ ID NO: 1312 - protein, 36 aa, Artificial Sequence
  Description of Artificial Sequence: Synthetic peptide
PAMAVVAGQYCRDSFYDRLSALVGDAWRCGAAAGAP

SEQ ID NO: 1313 - protein, 36 aa, Artificial Sequence
  Description of Artificial Sequence: Synthetic peptide
PAMACTASRFCAVSFYEWFAAQLPDLGGDSAAAGAP

SEQ ID NO: 1314 - protein, 36 aa, Artificial Sequence
  Description of Artificial Sequence: Synthetic peptide
PAMAGITLQSCGGGFYELLASVVGDTGCRLAAAGAP

SEQ ID NO: 1315 - protein, 36 aa, Artificial Sequence
  Description of Artificial Sequence: Synthetic peptide
PAMAGYICRSCQGSFYGCLAALVRDPRCSRAAAGAP

SEQ ID NO: 1316 - protein, 36 aa, Artificial Sequence; identical to SEQ ID NO: 1296
  Description of Artificial Sequence: Synthetic peptide

SEQ ID NO: 1317 - protein, 36 aa, Artificial Sequence
  Description of Artificial Sequence: Synthetic peptide
RPWRVAGAPRCHDPFYEWFAVEAQEPLRCEAAAGAP

SEQ ID NO: 1318 - protein, 36 aa, Artificial Sequence; identical to SEQ ID NO: 1291
  Description of Artificial Sequence: Synthetic peptide

SEQ ID NO: 1319 - protein, 36 aa, Artificial Sequence
  Description of Artificial Sequence: Synthetic peptide
PAMASICGQSCRDPFYAGLRGLLLEPLQLGAAAGAP

SEQ ID NO: 1320 - protein, 36 aa, Artificial Sequence
  Description of Artificial Sequence: Synthetic peptide
PAMAGVMSKCCSGSFYDWLADLVPEASWSWAAAGAP

SEQ ID NO: 1321 - protein, 36 aa, Artificial Sequence
  Description of Artificial Sequence: Synthetic peptide
PAMASFSGEACGGSFYDCLAGLMRDSSVSRAAAGAP

SEQ ID NO: 1322 - protein, 36 aa, Artificial Sequence
  Description of Artificial Sequence: Synthetic peptide
PAMASFSFYTCMETLLDGFGGQAFNRCRRTAAAGAP

SEQ ID NO: 1323 - protein, 36 aa, Artificial Sequence
  Description of Artificial Sequence: Synthetic peptide
PAMARVIYPTCPRDFYGGLAALVFGPHVCGAAAGAP

SEQ ID NO: 1324 - protein, 36 aa, Artificial Sequence
  Description of Artificial Sequence: Synthetic peptide
PAMAGIGSQACTDPFYYWFEGLVSNGGWCRAAAGAP

SEQ ID NO: 1325 - protein, 36 aa, Artificial Sequence; identical to SEQ ID NO: 1296
  Description of Artificial Sequence: Synthetic peptide

SEQ ID NO: 1326 - protein, 36 aa, Artificial Sequence; identical to SEQ ID NO: 1300
  Description of Artificial Sequence: Synthetic peptide

SEQ ID NO: 1327 - protein, 36 aa, Artificial Sequence
  Description of Artificial Sequence: Synthetic peptide
PAMADMMSQVCSQSMTGRFSVDFYDGLRCLAAAGAP

SEQ ID NO: 1328 - protein, 36 aa, Artificial Sequence; identical to SEQ ID NO: 1305
  Description of Artificial Sequence: Synthetic peptide

SEQ ID NO: 1329 - protein, 36 aa, Artificial Sequence
  Description of Artificial Sequence: Synthetic peptide
PAMARVIQEACGGSFYDGLACLVYPQGWRGAAAGAP

SEQ ID NO: 1330 - protein, 36 aa, Artificial Sequence
  Description of Artificial Sequence: Synthetic peptide
PAMAGGRSVACQESFYALLGCVVMGPGGGSAAAGAP

SEQ ID NO: 1331 - protein, 36 aa, Artificial Sequence
  Description of Artificial Sequence: Synthetic peptide
PAMAGISFRSCLQALIAGSAGNASEMGCRSAAAGAP

SEQ ID NO: 1332 - protein, 36 aa, Artificial Sequence
  Description of Artificial Sequence: Synthetic peptide
PAMAGIRDSYCQGAFYDWFAGLVDDGLFCQAAAGAP

SEQ ID NO: 1333 - protein, 36 aa, Artificial Sequence
  Description of Artificial Sequence: Synthetic peptide
PAMAGISYQSCEDSFYAWFACTVLDTRGGGAAAGAP

SEQ ID NO: 1334 - protein, 36 aa, Artificial Sequence
  Description of Artificial Sequence: Synthetic peptide
PAMARVIYEACGGSFYDGLACLVYPQGWRGAAAGAP

SEQ ID NO: 1335 - protein, 36 aa, Artificial Sequence
  Description of Artificial Sequence: Synthetic peptide
PAMADMPLLECLDPFYSWFAGQVSDPRFCGAAAGAP

SEQ ID NO: 1336 - protein, 36 aa, Artificial Sequence; identical to SEQ ID NO: 1329
  Description of Artificial Sequence: Synthetic peptide

SEQ ID NO: 1337 - protein, 36 aa, Artificial Sequence; identical to SEQ ID NO: 1296
  Description of Artificial Sequence: Synthetic peptide

SEQ ID NO: 1338 - protein, 36 aa, Artificial Sequence
  Description of Artificial Sequence: Synthetic peptide
PAMAHISFHSCLEALQDPEWGQPSAAWRNCAAAGAP

SEQ ID NO: 1339 - protein, 36 aa, Artificial Sequence
  Description of Artificial Sequence: Synthetic peptide
PAMAMTAQESCPDSFYECLAVLVGDRWGGWAAAGAP

SEQ ID NO: 1340 - protein, 36 aa, Artificial Sequence; identical to SEQ ID NO: 1338
  Description of Artificial Sequence: Synthetic peptide

SEQ ID NO: 1341 - protein, 36 aa, Artificial Sequence
  Description of Artificial Sequence: Synthetic peptide
PAMAGTISQCCEENFYAGLAHLAGVGQWGCAAAGAP

SEQ ID NO: 1342 - protein, 29 aa, Artificial Sequence
  Description of Artificial Sequence: Synthetic peptide
DDDKTFYACLEFLLSGNPEGNSGPWDRCR

SEQ ID NO: 1343 - protein, 29 aa, Artificial Sequence
  Description of Artificial Sequence: Synthetic peptide
DDDKIFYSCLASLLHGGPQRNTGPWERCR

SEQ ID NO: 1344 - protein, 29 aa, Artificial Sequence
  Description of Artificial Sequence: Synthetic peptide
DDDKTFYSCLASLLTGPREQNRGAWERCR

SEQ ID NO: 1345 - protein, 29 aa, Artificial Sequence
  Description of Artificial Sequence: Synthetic peptide
DDDKSFYSCLASLLTASRLPSRGAWDGCH

SEQ ID NO: 1346 - protein, 29 aa, Artificial Sequence
  Description of Artificial Sequence: Synthetic peptide
DDDKSFYSCLGSLLTGAPQPIRGAWDRCR

SEQ ID NO: 1347 - protein, 29 aa, Artificial Sequence
  Description of Artificial Sequence: Synthetic peptide
DDDKSFYSCLASLWSGTGGSSRGRWEGCR

SEQ ID NO: 1348 - protein, 29 aa, Artificial Sequence
  Description of Artificial Sequence: Synthetic peptide
DDDKTFYSCLGALLAGTGERNLRPWGRCR

SEQ ID NO: 1349 - protein, 29 aa, Artificial Sequence
  Description of Artificial Sequence: Synthetic peptide
DDDKTFYSCLGSLLTGPSDPKRGPWGGCR

SEQ ID NO: 1350 - protein, 29 aa, Artificial Sequence
  Description of Artificial Sequence: Synthetic peptide
DDDKTFYKCLASVLTGSTQTKRRPWEGCR

SEQ ID NO: 1351 - protein, 29 aa, Artificial Sequence
  Description of Artificial Sequence: Synthetic peptide
DDDKPFYSCLATLLTDPPQSQRGAWGRCR

SEQ ID NO: 1352 - protein, 29 aa, Artificial Sequence
  Description of Artificial Sequence: Synthetic peptide
DDDKSFYSCLAALLTGSSQSSGGAWMLCR

SEQ ID NO: 1353 - protein, 29 aa, Artificial Sequence
  Description of Artificial Sequence: Synthetic peptide
DDDKSFYSCLASLVAGTPWPKGGSWERCR

SEQ ID NO: 1354 - protein, 29 aa, Artificial Sequence
  Description of Artificial Sequence: Synthetic peptide
DDDKSFYSCLASLVTGIPRSNSGTQVFCR

SEQ ID NO: 1355 - protein, 29 aa, Artificial Sequence
  Description of Artificial Sequence: Synthetic peptide
DDDKSFYSCMASLLTGTPESRRGMGERCG

SEQ ID NO: 1356 - protein, 29 aa, Artificial Sequence
  Description of Artificial Sequence: Synthetic peptide
DDDKAFYSCLASLLTGSPPAQGGPWDRCR

SEQ ID NO: 1357 - protein, 29 aa, Artificial Sequence
  Description of Artificial Sequence: Synthetic peptide
DDDKFFYSCLASLLSDTPQRRRGPGVRCR

SEQ ID NO: 1358 - protein, 29 aa, Artificial Sequence
  Description of Artificial Sequence: Synthetic peptide
DDDKTFYSCLASLLAGNPQPNRAGWEYCR

SEQ ID NO: 1359 - protein, 29 aa, Artificial Sequence
  Description of Artificial Sequence: Synthetic peptide
DDDKTFYSCLGSLLLGPPQKNPGPGERCR

SEQ ID NO: 1360 - protein, 29 aa, Artificial Sequence
  Description of Artificial Sequence: Synthetic peptide
DDDKMFYSCLESLLIGRWPRNGGSLSRCR

SEQ ID NO: 1361 - protein, 29 aa, Artificial Sequence
  Description of Artificial Sequence: Synthetic peptide
DDDKSFYSCLTFLLTGTPQANDASWERCR

SEQ ID NO: 1362 - protein, 29 aa, Artificial Sequence
  Description of Artificial Sequence: Synthetic peptide
DDDKSFYSCMAALLSGAPQKSRGRWERCG

SEQ ID NO: 1363 - protein, 29 aa, Artificial Sequence
  Description of Artificial Sequence: Synthetic peptide
DDDKAFYRCLAYLLAGRPQASGGGGVRCR

SEQ ID NO: 1364 - protein, 29 aa, Artificial Sequence
  Description of Artificial Sequence: Synthetic peptide
DDDKAFYSCLAALRERSPQMSRGTWGGCR

SEQ ID NO: 1365 - protein, 29 aa, Artificial Sequence
  Description of Artificial Sequence: Synthetic peptide
DDDKTFYACLAALLGGTAELHDGSLECRG

SEQ ID NO: 1366 - protein, 29 aa, Artificial Sequence
  Description of Artificial Sequence: Synthetic peptide
DDDKTFYSCLGSLLTGTLPPARGARNICR

SEQ ID NO: 1367 - protein, 29 aa, Artificial Sequence
  Description of Artificial Sequence: Synthetic peptide
DDDKTFYSCLSSLLAGSPLPRRDLWAGCR

SEQ ID NO: 1368 - protein, 29 aa, Artificial Sequence
  Description of Artificial Sequence: Synthetic peptide
DDDKAFYSCMASLLAGTPEAQGSAWVRCR

SEQ ID NO: 1369 - protein, 29 aa, Artificial Sequence
  Description of Artificial Sequence: Synthetic peptide
DDDKNFYACMESLVSVAPPSSRDPFECRR

SEQ ID NO: 1370 - protein, 29 aa, Artificial Sequence
  Description of Artificial Sequence: Synthetic peptide
  MOD_RES (19): Unknown amino acid
DDDKSFYSCLASLVSGTAXPNRGPWERCR

SEQ ID NO: 1371 - protein, 29 aa, Artificial Sequence
  Description of Artificial Sequence: Synthetic peptide
DDDKIFYSCLASLLDDTAQSRRGQWARCR

SEQ ID NO: 1372 - protein, 29 aa, Artificial Sequence
  Description of Artificial Sequence: Synthetic peptide
DDDKIFYSCLGALLSGTPQTSHVTSGRCR

SEQ ID NO: 1373 - protein, 29 aa, Artificial Sequence
  Description of Artificial Sequence: Synthetic peptide
TDDKTFYFCLASLLAGTQQQSRGAWERCG

SEQ ID NO: 1374 - protein, 29 aa, Artificial Sequence
  Description of Artificial Sequence: Synthetic peptide
DDDKAFYSCLASVLTGSPHPGRSRWERCR

SEQ ID NO: 1375 - protein, 29 aa, Artificial Sequence
  Description of Artificial Sequence: Synthetic peptide
DDDKTFYSCLESMLTGTPPPCRGHGERGR

SEQ ID NO: 1376 - protein, 29 aa, Artificial Sequence
  Description of Artificial Sequence: Synthetic peptide
DDDKTFESCLEALVSGGSRRERGLWYRCR

SEQ ID NO: 1377 - protein, 29 aa, Artificial Sequence
  Description of Artificial Sequence: Synthetic peptide
DDDKAFYSCLSSLLAGTRERHRDTWPRCG

SEQ ID NO: 1378 - protein, 29 aa, Artificial Sequence
  Description of Artificial Sequence: Synthetic peptide
DDDKTFHSCLAALVTGTPQQKRGPWERCR

SEQ ID NO: 1379 - protein, 29 aa, Artificial Sequence
  Description of Artificial Sequence: Synthetic peptide
DDDKTFYLCLASLQTVTRLGDRVPWERCR

SEQ ID NO: 1380 - protein, 29 aa, Artificial Sequence
  Description of Artificial Sequence: Synthetic peptide
DDDKTFYSCLVSLLNGTAKPNRGQWEGCR

SEQ ID NO: 1381 - protein, 29 aa, Artificial Sequence
  Description of Artificial Sequence: Synthetic peptide
DDDKSFYSCLASLSNCTPGLLRCQWERCR

SEQ ID NO: 1382 - protein, 29 aa, Artificial Sequence
  Description of Artificial Sequence: Synthetic peptide
DDDKTFYSCLSSLLASTPQPNRGAWLCRR

SEQ ID NO: 1383 - protein, 29 aa, Artificial Sequence
  Description of Artificial Sequence: Synthetic peptide
DDDKSFYSCLASLSNCTPGLLRCQWERCR

SEQ ID NO: 1384 - protein, 29 aa, Artificial Sequence
  Description of Artificial Sequence: Synthetic peptide
DDDKTFYSCLGALLSGAPQTYRGPGAGCR

SEQ ID NO: 1385 - protein, 29 aa, Artificial Sequence
  Description of Artificial Sequence: Synthetic peptide
DDDKTFYSCLVSLLNGTAKPNRGQWEGCR

SEQ ID NO: 1386 - protein, 29 aa, Artificial Sequence
  Description of Artificial Sequence: Synthetic peptide
DDDKHFYSCLSSLLTAPPQSTRGPAGRHC

SEQ ID NO: 1387 - protein, 29 aa, Artificial Sequence
  Description of Artificial Sequence: Synthetic peptide
DDDKTFYSCLASLLNGNTQPNGGQWVRCR

SEQ ID NO: 1388 - protein, 29 aa, Artificial Sequence
  Description of Artificial Sequence: Synthetic peptide
DDDKVFYTCLASLSTGTPQRQSGEWQRCR

SEQ ID NO: 1389 - protein, 29 aa, Artificial Sequence
  Description of Artificial Sequence: Synthetic peptide
DDDKTFYSCLVSLLNGTAKPNRGQWEGCR

SEQ ID NO: 1390 - protein, 29 aa, Artificial Sequence
  Description of Artificial Sequence: Synthetic peptide
DDDKPFYSCLASLIQGTPLPERGMWERCR

SEQ ID NO: 1391 - protein, 28 aa, Artificial Sequence
  Description of Artificial Sequence: Synthetic peptide
DDDKTFYSCVSWLLTGARQRDGVWERCR

SEQ ID NO: 1392 - protein, 29 aa, Artificial Sequence
  Description of Artificial Sequence: Synthetic peptide
DDDKTFYSCLVSLLNGTAKPNRGQWEGCR

SEQ ID NO: 1393 - protein, 29 aa, Artificial Sequence
  Description of Artificial Sequence: Synthetic peptide
DDDKAFYGCLAALLTGARQPSRGVGERCF

SEQ ID NO: 1394 - protein, 29 aa, Artificial Sequence
  Description of Artificial Sequence: Synthetic peptide
DDDKTFYSCLVSLLNGTAKPNRGQWEGCR

SEQ ID NO: 1395 - protein, 29 aa, Artificial Sequence
  Description of Artificial Sequence: Synthetic peptide
DDDKTFYSCLASLLAGSPQPKRAGWEYCR

SEQ ID NO: 1396 - protein, 29 aa, Artificial Sequence
  Description of Artificial Sequence: Synthetic peptide
DDDKPFYSCLESLVTGRPQADRGVWERCR

SEQ ID NO: 1397 - protein, 29 aa, Artificial Sequence
  Description of Artificial Sequence: Synthetic peptide
DDDKTFYSCLTSLSRGSAHGLSGRWERCR

SEQ ID NO: 1398 - protein, 30 aa, Artificial Sequence
  Description of Artificial Sequence: Synthetic peptide
DDDDKTFYFCLATLLTGPPVPNREPWACYR

SEQ ID NO: 1399 - protein, 29 aa, Artificial Sequence
  Description of Artificial Sequence: Synthetic peptide
DDDKIFYSCLRTLGTNPPEPVRGPFDRCG

SEQ ID NO: 1400 - protein, 29 aa, Artificial Sequence
  Description of Artificial Sequence: Synthetic peptide
DDDKTFYSCLVSLLNGTAKPNRGQWEGCR

SEQ ID NO: 1401 - protein, 29 aa, Artificial Sequence
  Description of Artificial Sequence: Synthetic peptide
NDDKSFYSCVASLVNEGPSQVGVLGERCR

SEQ ID NO: 1402 - protein, 29 aa, Artificial Sequence
  Description of Artificial Sequence: Synthetic peptide
DDDKTFYSCLASMLTGPPHPDRVPWDRCR

SEQ ID NO: 1403 - protein, 29 aa, Artificial Sequence
  Description of Artificial Sequence: Synthetic peptide
DDDKKFYSCLVELVNGTSPPARGLWERCR

SEQ ID NO: 1404 - protein, 29 aa, Artificial Sequence
  Description of Artificial Sequence: Synthetic peptide
DDDKVFYSCLESLVSGTPEVNGRAWERCR

SEQ ID NO: 1405 - protein, 29 aa, Artificial Sequence
  Description of Artificial Sequence: Synthetic peptide
YDDKRFYYCLASLASGTLQTNREQWERCR

SEQ ID NO: 1406 - protein, 29 aa, Artificial Sequence
  Description of Artificial Sequence: Synthetic peptide
DDDKTFYSCLESLLNGTPQRNRGQWDPCS

SEQ ID NO: 1407 - protein, 29 aa, Artificial Sequence
  Description of Artificial Sequence: Synthetic peptide
DDDKTFYTCLQALITGYERPVGGRWESCR

SEQ ID NO: 1408 - protein, 29 aa, Artificial Sequence
  Description of Artificial Sequence: Synthetic peptide
DDDKAFYSCLATLLYGNPPSSRGQWHRCR

SEQ ID NO: 1409 - protein, 29 aa, Artificial Sequence
  Description of Artificial Sequence: Synthetic peptide
DDDKVFYSCLESLVSGTPEVNGRAWERCR

SEQ ID NO: 1410 - protein, 29 aa, Artificial Sequence
  Description of Artificial Sequence: Synthetic peptide
GDDKTFYACLSSLLYGTADWSQGQRDRCR

SEQ ID NO: 1411 - protein, 29 aa, Artificial Sequence
  Description of Artificial Sequence: Synthetic peptide
DDDKSFYSCMESLWTDTPQPNRGRWERCR

SEQ ID NO: 1412 - protein, 29 aa, Artificial Sequence
  Description of Artificial Sequence: Synthetic peptide
DDDKTFYSCLASLLTVSPEPSRGPWERCR

SEQ ID NO: 1413 - protein, 29 aa, Artificial Sequence
  Description of Artificial Sequence: Synthetic peptide
DDDKTFYSCMVQLLTGTPEKSCVTWERWR

SEQ ID NO: 1414 - protein, 29 aa, Artificial Sequence
  Description of Artificial Sequence: Synthetic peptide
DDDKTFYSCLVSLLNGTAKPNRGQWEGCR

SEQ ID NO: 1415 - protein, 29 aa, Artificial Sequence
  Description of Artificial Sequence: Synthetic peptide
DDDKTFYSCVASLVVGTAQPQCGPWQGWG

SEQ ID NO: 1416 - protein, 29 aa, Artificial Sequence
  Description of Artificial Sequence: Synthetic peptide
DDDKTFYSCLAGLVTGPPRQNWGAGDACR

SEQ ID NO: 1417 - protein, 29 aa, Artificial Sequence
  Description of Artificial Sequence: Synthetic peptide
DDDKTFYSCMSSLSTTAPQPKSGRWDRCR

SEQ ID NO: 1418 - protein, 29 aa, Artificial Sequence
  Description of Artificial Sequence: Synthetic peptide
DDDKTFYSCLASLVNGSLQPNRAPGELCR

SEQ ID NO: 1419 - protein, 29 aa, Artificial Sequence
  Description of Artificial Sequence: Synthetic peptide
DDDKTFYSCLVSLLNGTAKPNRGQWEGCR

SEQ ID NO: 1420 - protein, 29 aa, Artificial Sequence
  Description of Artificial Sequence: Synthetic peptide
DDDKTFYSCLVSLLNGTAKPNRGQWEGCR

SEQ ID NO: 1421 - protein, 29 aa, Artificial Sequence
  Description of Artificial Sequence: Synthetic peptide
DDDKSFYSCLESLLNGGPQQKRGPWEGCR

SEQ ID NO: 1422 - protein, 29 aa, Artificial Sequence
  Description of Artificial Sequence: Synthetic peptide
DDDKTFYSCLASLLNGNTQPNGGQWVRCR

SEQ ID NO: 1423 - protein, 29 aa, Artificial Sequence
  Description of Artificial Sequence: Synthetic peptide
DDDKSFYSCLASLSNCTPGLLRCQWERCR

SEQ ID NO: 1424 - protein, 29 aa, Artificial Sequence
  Description of Artificial Sequence: Synthetic peptide
DDDKNFYSCLSALLNGNTVSDRGQGERCF

SEQ ID NO: 1425 - protein, 27 aa, Artificial Sequence
  Description of Artificial Sequence: Synthetic peptide
DDTFYSCLASLVNGSPQAYGGPREHCR

SEQ ID NO: 1426 - protein, 29 aa, Artificial Sequence
  Description of Artificial Sequence: Synthetic peptide
DDDKIFYSCLAWLMTGPAPPYRGPWSCWS

SEQ ID NO: 1427 - protein, 29 aa, Artificial Sequence
  Description of Artificial Sequence: Synthetic peptide
DDDKIFYACLSSLSTGTWQPKRGPGERCR

SEQ ID NO: 1428 - protein, 29 aa, Artificial Sequence
  Description of Artificial Sequence: Synthetic peptide
DDDKSFYSCLASLSNCTPGLLRCQWERCR

SEQ ID NO: 1429 - protein, 29 aa, Artificial Sequence
  Description of Artificial Sequence: Synthetic peptide
DDDKTFYSCLGSLINGTPPPHRGLWQGCR

SEQ ID NO: 1430 - protein, 29 aa, Artificial Sequence
  Description of Artificial Sequence: Synthetic peptide
DDDKTFYSCLVSLLNGTAKPNRGQWEGCR

SEQ ID NO: 1431 - protein, 29 aa, Artificial Sequence
  Description of Artificial Sequence: Synthetic peptide
DDDKQFYSCLAFLASGIAQPQPGAWELCR

SEQ ID NO: 1432 - protein, 29 aa, Artificial Sequence
  Description of Artificial Sequence: Synthetic peptide
DDDKTFYCCLAALLTGAPPPKGGTCERCG

SEQ ID NO: 1433 - protein, 43 aa, Artificial Sequence
  Description of Artificial Sequence: Synthetic peptide
FHENFYDWFARKDSGGSGGSGGSDLCVLEELFWGDSLFDYCTG

SEQ ID NO: 1434 - protein, 43 aa, Artificial Sequence
  Description of Artificial Sequence: Synthetic peptide
  MOD_RES (6): Unknown amino acid
FHENFXDWFVRQVSGGSGGSGGSNLCVLEELFWGASLFGECSG

SEQ ID NO: 1435 - protein, 43 aa, Artificial Sequence
  Description of Artificial Sequence: Synthetic peptide
SHGNFSEWFVRQGYGGSGGSGGSDLCVLEELYWGASLFGYCSG

SEQ ID NO: 1436 - protein, 43 aa, Artificial Sequence
  Description of Artificial Sequence: Synthetic peptide
  MOD_RES (12): Unknown amino acid
FQESFYDWFVRXVTGGSGGSGGSDLCGVEDLVWGSALSGYCAG

SEQ ID NO: 1437 - protein, 43 aa, Artificial Sequence
  Description of Artificial Sequence: Synthetic peptide
FHENFNDWFVREVSGGSGGSGGSDLCVLEELFWGASLFSYCSG

SEQ ID NO: 1438 - protein, 43 aa, Artificial Sequence
  Description of Artificial Sequence: Synthetic peptide
  MOD_RES (12): Unknown amino acid
SHENFYDWFVRXGPGGSGGSGGSHLCVLEELFWGDSLFGACPG

SEQ ID NO: 1439 - protein, 43 aa, Artificial Sequence
  Description of Artificial Sequence: Synthetic peptide
  MOD_RES (40): Unknown amino acid
FHENFYDWFARQVSGGSGGSGGSHLCVLEELFWGASLFAXCSD

SEQ ID NO: 1440 - protein, 43 aa, Artificial Sequence
  Description of Artificial Sequence: Synthetic peptide
  MOD_RES (12): Unknown amino acid
FPDNFYDWFVRXVSGGSGGSGGSHLCVLEELFWGASPFGYCSG

SEQ ID NO: 1441 - protein, 43 aa, Artificial Sequence
  Description of Artificial Sequence: Synthetic peptide
FQENFYDWFGRQISGGSGGSGGSPLCDVEELFWGVSLFGYCTG

SEQ ID NO: 1442 - protein, 43 aa, Artificial Sequence
  Description of Artificial Sequence: Synthetic peptide
  MOD_RES (12): Unknown amino acid
FQENFYDWFVRXASGGSGGSGGSHLCALEEQFWGSSQFRYCSG

SEQ ID NO: 1443 - protein, 43 aa, Artificial Sequence
  Description of Artificial Sequence: Synthetic peptide
  MOD_RES (33): Unknown amino acid
FHENFYDWFARQVYGGSGGSGGSHLCVLEELFXGASLFATCSD

SEQ ID NO: 1444 - protein, 43 aa, Artificial Sequence
  Description of Artificial Sequence: Synthetic peptide
  MOD_RES (33): Unknown amino acid
FHENFYDRIVRQVAGGSGGSGGSALCVREELFXGDSLFGDCSG

SEQ ID NO: 1445 - protein, 43 aa, Artificial Sequence
  Description of Artificial Sequence: Synthetic peptide
  MOD_RES (38): Unknown amino acid
FHKNFYDWFDRQVSGGSGGSGSSRLCDLEELFWGASLXGHCSG

SEQ ID NO: 1446 - protein, 43 aa, Artificial Sequence
  Description of Artificial Sequence: Synthetic peptide
FHENFYDWFIRQDSGGSGGSGGSHLCAFEELLGGASPFGYCSG

SEQ ID NO: 1447 - protein, 43 aa, Artificial Sequence
  Description of Artificial Sequence: Synthetic peptide
  MOD_RES (12): Unknown amino acid
SNENFYDWFDRXVSGGSGGSGGSHLCLLEELSWGASLFGYCYG

SEQ ID NO: 1448 - protein, 43 aa, Artificial Sequence
  Description of Artificial Sequence: Synthetic peptide
  MOD_RES (31): Unknown amino acid
FHESFYDWFDRQVSGGSGGSGGSHLCVLEEXELGASVFGCCSG

SEQ ID NO: 1449 - protein, 36 aa, Artificial Sequence
  Description of Artificial Sequence: Synthetic peptide
  MOD_RES (12): Unknown amino acid
FHETFYDWFDRXVSGGSGGSGEELFGGASLFGYPSG

SEQ ID NO: 1450 - protein, 43 aa, Artificial Sequence
  Description of Artificial Sequence: Synthetic peptide
  MOD_RES (33): Unknown amino acid
SHENFYDWFGRQVSGGSGGSGGSNLCDLDEVSXGASLCGYRSG

SEQ ID NO: 1451 - protein, 44 aa, Artificial Sequence
  Description of Artificial Sequence: Synthetic peptide
  MOD_RES (3): Unknown amino acid
  MOD_RES (43): Unknown amino acid
FHXNFYDWFFCQVPEWIPMTLAVLTCAVLEEPIWGDSLFGYGXE

SEQ ID NO: 1452 - protein, 43 aa, Artificial Sequence
  Description of Artificial Sequence: Synthetic peptide
  MOD_RES (14): Unknown amino acid
SHENFYDWFVRQVXGGSGGSGGSHLCDLEELLGGASLMGSCSG

SEQ ID NO: 1453 - protein, 42 aa, Artificial Sequence
  Description of Artificial Sequence: Synthetic peptide
  MOD_RES (12): Unknown amino acid
  MOD_RES (38): Unknown amino acid
SHENFYDWFVRXVSGGAAAGAPPAMASHENFYDWFVRXVSGG

SEQ ID NO: 1454 - protein, 40 aa, Artificial Sequence
  Description of Artificial Sequence: Synthetic peptide
  MOD_RES (12): Unknown amino acid
FHENFYDWFIRXVGGGSGGSGGSDLCVLEDDCSRAAAGAP

SEQ ID NO: 1455 - protein, 25 aa, Artificial Sequence
  Description of Artificial Sequence: Synthetic peptide
  MOD_RES (22): Unknown amino acid
DYKDASVSGTFHDAFYEWFWRXVGS

SEQ ID NO: 1456 - protein, 43 aa, Artificial Sequence
  Description of Artificial Sequence: Synthetic peptide
  MOD_RES (24): Unknown amino acid
  MOD_RES (40): Unknown amino acid
FHENFYDLVPSAGSWWIRWLWRFXPVRLGRTVLGCFSDRXLFW

SEQ ID NO: 1457 - protein, 28 aa, Artificial Sequence
  Description of Artificial Sequence: Synthetic peptide
FHENFYDWFDRQVSGGSGGSVRAAAGAP

SEQ ID NO: 1458 - protein, 43 aa, Artificial Sequence
  Description of Artificial Sequence: Synthetic peptide
  MOD_RES (29): Unknown amino acid
VHENFYDWFDRQVSGGSGGSGGSQLCDLXEVIWGASLFGYCTG

SEQ ID NO: 1459 - protein, 43 aa, Artificial Sequence
  Description of Artificial Sequence: Synthetic peptide
  MOD_RES (12): Unknown amino acid
FHENFYDWFDRXVSGGSGGSGGSHLCVPEEQFWGASRFGYCSA

SEQ ID NO: 1460 - protein, 37 aa, Artificial Sequence
  Description of Artificial Sequence: Synthetic peptide
  MOD_RES (32): Unknown amino acid
FHDNFYDWFVRQVSGGSGGSGGSRQCQGASLXGYCSG

SEQ ID NO: 1461 - protein, 33 aa, Artificial Sequence
  Description of Artificial Sequence: Synthetic peptide
  MOD_RES (12): Unknown amino acid
FHEDFYDWFVRXVPGGSGGSGGSHLCVPGYCSS

SEQ ID NO: 1462 - protein, 36 aa, Artificial Sequence
  Description of Artificial Sequence: Synthetic peptide
  MOD_RES (12): Unknown amino acid
FRENFYDWFVCXVSGGSGGSGGSNLCVLEEAAAGAP

SEQ ID NO: 1463 - protein, 38 aa, Artificial Sequence
  Description of Artificial Sequence: Synthetic peptide
  MOD_RES (28): Unknown amino acid
GHDNFYDWFVRQVSGGSGGSGGSHLCVXGAFPWGYCSD

SEQ ID NO: 1464 - protein, 29 aa, Artificial Sequence
  Description of Artificial Sequence: Synthetic peptide
  MOD_RES (3): Unknown amino acid
FHXNFYDWFVRQVYGGSGGSGTGAAAGAP

SEQ ID NO: 1465 - protein, 43 aa, Artificial Sequence
  Description of Artificial Sequence: Synthetic peptide
  MOD_RES (33): Unknown amino acid
FHENFYDWFGRQVYGGSGGSGGSPVCILGELSXGGALFGDCSG

SEQ ID NO: 1466 - protein, 43 aa, Artificial Sequence
  Description of Artificial Sequence: Synthetic peptide
  MOD_RES (12): Unknown amino acid
FHENFYDWFVRXLSGGSGGSGGSHLCVPEERLWGDPLFGYCSG

SEQ ID NO: 1467 - protein, 27 aa, Artificial Sequence
  Description of Artificial Sequence: Synthetic peptide
  MOD_RES (3): Unknown amino acid
FHXNFYDWFVRQVSGGSGGSGGSHPAR

SEQ ID NO: 1468 - protein, 43 aa, Artificial Sequence
  Description of Artificial Sequence: Synthetic peptide
  MOD_RES (33): Unknown amino acid
FHENFYDWFVRQVTGGSGGSGGSHLCVLEELSXGAALPGYCSG

SEQ ID NO: 1469 - protein, 30 aa, Artificial Sequence
  Description of Artificial Sequence: Synthetic peptide
  MOD_RES (27): Unknown amino acid
VQGSFYDWFVRQVSGGSGGSGGSHLCXGSG

SEQ ID NO: 1470 - protein, 37 aa, Artificial Sequence
  Description of Artificial Sequence: Synthetic peptide
  MOD_RES (33): Unknown amino acid
FHENFYEWFVRQVSGGSGGSGGSHRCDVEELHXCASG

SEQ ID NO: 1471 - protein, 25 aa, Artificial Sequence
  Description of Artificial Sequence: Synthetic peptide
  MOD_RES (17): Unknown amino acid
DYKDGGYWGSFYEGLMXLVQSGTSG

SEQ ID NO: 1472 - protein, 43 aa, Artificial Sequence
  Description of Artificial Sequence: Synthetic peptide
  MOD_RES (40): Unknown amino acid
FHENFYDWFDRQVSGGSGGSGGSHRCVLEERFWGASLFGXCSG

SEQ ID NO: 1473 - protein, 43 aa, Artificial Sequence
  Description of Artificial Sequence: Synthetic peptide
  MOD_RES (33): Unknown amino acid
SHENFYDWFVHQVSGGSGGSGGSHLCVLEERFXGPSLFGYCSG

SEQ ID NO: 1474 - protein, 43 aa, Artificial Sequence
  Description of Artificial Sequence: Synthetic peptide
  MOD_RES (33): Unknown amino acid
FHANFYDWFFRQVSGGSGGSGGSDLCVLQDMFXGGSGAAAGAP

SEQ ID NO: 1475 - protein, 43 aa, Artificial Sequence
  Description of Artificial Sequence: Synthetic peptide
  MOD_RES (33): Unknown amino acid
FQDNFYDWFVRQISGGSGGSGGSHLCVLESWFXGASLFGYCSG

SEQ ID NO: 1476 - protein, 43 aa, Artificial Sequence
  Description of Artificial Sequence: Synthetic peptide
  MOD_RES (8): Unknown amino acid
FHETFYDXLGRLVFGGSGGSGGSHLCVPEELFWGTSLLSYCSG

SEQ ID NO: 1477 - protein, 29 aa, Artificial Sequence
  Description of Artificial Sequence: Synthetic peptide
  MOD_RES (26): Unknown amino acid
FHENFYDWFVRQVSGGSGGSGGSHLXGSG

SEQ ID NO: 1478 - protein, 43 aa, Artificial Sequence
  Description of Artificial Sequence: Synthetic peptide
  MOD_RES (33): Unknown amino acid
FHENFYDWFVRQVSGGSGGSGGSHRCGLEEPVXGASLVGYCAG

SEQ ID NO: 1479 - protein, 24 aa, Artificial Sequence
  Description of Artificial Sequence: Synthetic peptide
  MOD_RES (14): Unknown amino acid
FHANFYDWFVRQVXGGSGGSGGSG

SEQ ID NO: 1480 - protein, 43 aa, Artificial Sequence
  Description of Artificial Sequence: Synthetic peptide
  MOD_RES (33): Unknown amino acid
FHEDFYDWFVRQVGGGSGGSGGSHLCVREELFXGASLLGDCSG

SEQ ID NO: 1481 - protein, 31 aa, Artificial Sequence
  Description of Artificial Sequence: Synthetic peptide
  MOD_RES (1): Unknown amino acid
XHENFYDWFVRQLSGGSGGSDGSHLFGYGSG

SEQ ID NO: 1482 - protein, 43 aa, Artificial Sequence
  Description of Artificial Sequence: Synthetic peptide
FHENFYDWFDRQVGGGSGGSGGFSPVRTGRTVLGGFSVRLLLW

SEQ ID NO: 1483 - protein, 33 aa, Artificial Sequence
  Description of Artificial Sequence: Synthetic peptide
  MOD_RES (12): Unknown amino acid
SHDNFYDWFVRXVSGGSGGSGGSPLCVLGNCSG

SEQ ID NO: 1484 - protein, 43 aa, Artificial Sequence
  Description of Artificial Sequence: Synthetic peptide
  MOD_RES (12): Unknown amino acid
FYDNFYHWFDRXVSGGSGGSGGSHLCVLEERVCGASLFDYRSG

SEQ ID NO: 1485 - protein, 43 aa, Artificial Sequence
  Description of Artificial Sequence: Synthetic peptide
  MOD_RES (33): Unknown amino acid
FSEHFYDWFARQVSGGSGGSGGSHLCVLDERFXGASMVGYCSG

SEQ ID NO: 1486 - protein, 29 aa, Artificial Sequence
  Description of Artificial Sequence: Synthetic peptide
  MOD_RES (26): Unknown amino acid
FPENFYDWFDRQVSGGSGGGASLFGXGSG

SEQ ID NO: 1487 - protein, 43 aa, Artificial Sequence
  Description of Artificial Sequence: Synthetic peptide
FHENFYDWFDRQVSGGSSGSGGSHQCVQEERFWGASLCGYCSG

SEQ ID NO: 1488 - protein, 43 aa, Artificial Sequence
  Description of Artificial Sequence: Synthetic peptide
  MOD_RES (33): Unknown amino acid
FHDSFYDWFVRQVSGGSGGSGGSHLCGLEELFXGASRFGDCSG

SEQ ID NO: 1489 - protein, 35 aa, Artificial Sequence
  Description of Artificial Sequence: Synthetic peptide
  MOD_RES (12): Unknown amino acid
FHGDFYDWFVRXVSGGSGGSGGSHLCVLEELYCSG

SEQ ID NO: 1490 - protein, 43 aa, Artificial Sequence
  Description of Artificial Sequence: Synthetic peptide
  MOD_RES (12): Unknown amino acid
FHDNFYDWFVRXVSGGSGGSGGSHLCVVEERFWGGSPIGYCSG

SEQ ID NO: 1491 - protein, 33 aa, Artificial Sequence
  Description of Artificial Sequence: Synthetic peptide
FQDNFYDWFVRQVSGGSGGSGGSHRCVLEGCSG

SEQ ID NO: 1492 - protein, 26 aa, Artificial Sequence
  Description of Artificial Sequence: Synthetic peptide
FHENFYDWFDRQVSGGSACLFGYCSG

SEQ ID NO: 1493 - protein, 18 aa, Artificial Sequence
  Description of Artificial Sequence: Synthetic peptide
  MOD_RES (12): Unknown amino acid
YHENFYDWFVRXVSGGSG

SEQ ID NO: 1494 - protein, 32 aa, Artificial Sequence
  Description of Artificial Sequence: Synthetic peptide
  MOD_RES (12): Unknown amino acid
VHESFYDWFVRXVAGGSGGSGGSHLCDVDCSG

SEQ ID NO: 1495 - protein, 29 aa, Artificial Sequence
  Description of Artificial Sequence: Synthetic peptide
  MOD_RES (26): Unknown amino acid
FHDNFYDWFDRQVSGGSGGSGSPFGXRSD

SEQ ID NO: 1496 - protein, 43 aa, Artificial Sequence
  Description of Artificial Sequence: Synthetic peptide
  MOD_RES (3): Unknown amino acid
FHXHFYDWFDRQVSGGSGGSGGSLLCVGEEPFWGASLFAYCSG

SEQ ID NO: 1497 - protein, 22 aa, Artificial Sequence
  Description of Artificial Sequence: Synthetic peptide
FHENFYDWFVRQVSGGSGGSGG

SEQ ID NO: 1498 - protein, 43 aa, Artificial Sequence
  Description of Artificial Sequence: Synthetic peptide
  MOD_RES (12): Unknown amino acid
FHESFYDWFVRXVPGGSGGSGGSQLCVQEELFEGDSLLGDCSG

SEQ ID NO: 1499 - protein, 36 aa, Artificial Sequence
  Description of Artificial Sequence: Synthetic peptide
  MOD_RES (26): Unknown amino acid
FHENFYEWFDRQVSGGSGGVLDERFXGACPSGYCSG

SEQ ID NO: 1500 - protein, 43 aa, Artificial Sequence
  Description of Artificial Sequence: Synthetic peptide
  MOD_RES (12): Unknown amino acid
FHDNFYDWFVRXVAGGSGGSGGSHLCVPEELFWGASLFGYCSG

SEQ ID NO: 1501 - protein, 43 aa, Artificial Sequence
  Description of Artificial Sequence: Synthetic peptide
  MOD_RES (12): Unknown amino acid
FGEDFYDWFVRXVSGGSGGSGGSHLCVLDELFWDASPFGFCPG

SEQ ID NO: 1502 - protein, 42 aa, Artificial Sequence
  Description of Artificial Sequence: Synthetic peptide
  MOD_RES (1): Unknown amino acid
XHDNFYGWFDRQVSGGSGGSGGSHLCVLDELLWGASLFGYCS

SEQ ID NO: 1503 - protein, 30 aa, Artificial Sequence
  Description of Artificial Sequence: Synthetic peptide
  MOD_RES (12): Unknown amino acid
FQENFYDWFVRXVSGDELSGGASQCGSCSG

SEQ ID NO: 1504 - protein, 43 aa, Artificial Sequence
  Description of Artificial Sequence: Synthetic peptide
  MOD_RES (40): Unknown amino acid
SHESFYDWFVRQVSGGSGGSGGSDLCVWEELCGGAPLVGXGSS

SEQ ID NO: 1505 - protein, 25 aa, Artificial Sequence
  Description of Artificial Sequence: Synthetic peptide
FPENFYDWFDRQVSGGSGGSGGSSG

SEQ ID NO: 1506 - protein, 43 aa, Artificial Sequence
  Description of Artificial Sequence: Synthetic peptide
FRENFYDWFERQVSGGSGGSGGSHLCVLEELSWGASTFGSCSG

SEQ ID NO: 1507 - protein, 43 aa, Artificial Sequence
  Description of Artificial Sequence: Synthetic peptide
  MOD_RES (12): Unknown amino acid
IHVDFYDWFARXVSGGSGGSGGSSLCVLDELFWDASLFGDCAG

SEQ ID NO: 1508 - protein, 43 aa, Artificial Sequence
  Description of Artificial Sequence: Synthetic peptide
FHASFYDWFDRQVSGGSGGSGGSHLCDLEGLFWGAAPFGYCSG

SEQ ID NO: 1509 - protein, 43 aa, Artificial Sequence
  Description of Artificial Sequence: Synthetic peptide
  MOD_RES (12): Unknown amino acid
SDANFYDWFLRXVSGGSGGSGGSHLCALEEQFWDASLFGDCSG

SEQ ID NO: 1510 - protein, 43 aa, Artificial Sequence
  Description of Artificial Sequence: Synthetic peptide
  MOD_RES (12): Unknown amino acid
FHDKFYDWFVSXVAGGSGGSGGSHLCVLEDRFWGSSLSGYCSG

SEQ ID NO: 1511 - protein, 43 aa, Artificial Sequence
  Description of Artificial Sequence: Synthetic peptide
  MOD_RES (42): Unknown amino acid
FHDNFYDWFVRQVTDGSGGSGGSQLCVVEDLFWDASRFGYCXG

SEQ ID NO: 1512 - protein, 43 aa, Artificial Sequence
  Description of Artificial Sequence: Synthetic peptide
  MOD_RES (12): Unknown amino acid
VSEDFYEWFVRXASGGSGGSGGSNLCVLEELFWGSSLIGDCSG

SEQ ID NO: 1513 - protein, 43 aa, Artificial Sequence
  Description of Artificial Sequence: Synthetic peptide
  MOD_RES (32): Unknown amino acid
FPENFYDWFVRQVSGGSGGSGGSHLCVLEELXWGASMFGYCSG

SEQ ID NO: 1514 - protein, 43 aa, Artificial Sequence
  Description of Artificial Sequence: Synthetic peptide
  MOD_RES (40): Unknown amino acid
FQENFYDWFVRQVSGGSGGSGGSHLCVLEALFWGASLFGXCSG

SEQ ID NO: 1515 - protein, 25 aa, Artificial Sequence
  Description of Artificial Sequence: Synthetic peptide
  MOD_RES (12): Unknown amino acid
  MOD_RES (24): Unknown amino acid
DYKDGRGGRRFXGRSSVVLWKRLXR

SEQ ID NO: 1516 - protein, 26 aa, Artificial Sequence
  Description of Artificial Sequence: Synthetic peptide
  MOD_RES (19): Unknown amino acid
DTKTFIGITGVLPRLSAVXGFWGGSW

SEQ ID NO: 1517 - protein, 43 aa, Artificial Sequence
  Description of Artificial Sequence: Synthetic peptide
  MOD_RES (29): Unknown amino acid
CHENFYVWFVSQVAGGSGGSGGSRLCIMXELFRGASLFGYSSG

SEQ ID NO: 1518 - protein, 43 aa, Artificial Sequence
  Description of Artificial Sequence: Synthetic peptide
  MOD_RES (12): Unknown amino acid
FHANFYDWFVRXVSGGSGGSGGSHLCVLEELVSGPSLLGYCSG

SEQ ID NO: 1519 - protein, 43 aa, Artificial Sequence
  Description of Artificial Sequence: Synthetic peptide
  MOD_RES (12): Unknown amino acid
FHEKFYDWFDLXLSGGSGGSGGSHLCVREEPFWGASLFGYCPG

SEQ ID NO: 1520 - protein, 20 aa, Artificial Sequence
  Description of Artificial Sequence: Synthetic peptide
HLCVLEELFWGASLFGYCSG

SEQ ID NO: 1521 - protein, 20 aa, Artificial Sequence
  Description of Artificial Sequence: Synthetic peptide
WLDQEWAWVQCEVYGRGCPS

SEQ ID NO: 1522 - protein, 33 aa, Artificial Sequence; identical to SEQ ID NO: 1483
  Description of Artificial Sequence: Synthetic peptide
  MOD_RES (12): Unknown amino acid

SEQ ID NO: 1523 - protein, 43 aa, Artificial Sequence; identical to SEQ ID NO: 1484
  Description of Artificial Sequence: Synthetic peptide
  MOD_RES (12): Unknown amino acid

SEQ ID NO: 1524 - protein, 43 aa, Artificial Sequence; identical to SEQ ID NO: 1487
  Description of Artificial Sequence: Synthetic peptide

SEQ ID NO: 1525 - protein, 35 aa, Artificial Sequence; identical to SEQ ID NO: 1489
  Description of Artificial Sequence: Synthetic peptide
  MOD_RES (12): Unknown amino acid

SEQ ID NO: 1526 - protein, 33 aa, Artificial Sequence; identical to SEQ ID NO: 1491
  Description of Artificial Sequence: Synthetic peptide

SEQ ID NO: 1527 - protein, 26 aa, Artificial Sequence
  Description of Artificial Sequence: Synthetic peptide
FHENFYDWFDRQVSGGSACLFGYCSG

SEQ ID NO: 1528 - protein, 32 aa, Artificial Sequence; identical to SEQ ID NO: 1494
  Description of Artificial Sequence: Synthetic peptide
  MOD_RES (12): Unknown amino acid

SEQ ID NO: 1529 - protein, 36 aa, Artificial Sequence; identical to SEQ ID NO: 1499
  Description of Artificial Sequence: Synthetic peptide
  MOD_RES (26): Unknown amino acid

SEQ ID NO: 1530 - protein, 30 aa, Artificial Sequence; identical to SEQ ID NO: 1503
  Description of Artificial Sequence: Synthetic peptide
  MOD_RES (12): Unknown amino acid

SEQ ID NO: 1531 - protein, 43 aa, Artificial Sequence; identical to SEQ ID NO: 1504
  Description of Artificial Sequence: Synthetic peptide
  MOD_RES (40): Unknown amino acid

SEQ ID NO: 1532 - protein, 24 aa, Artificial Sequence
  Description of Artificial Sequence: Synthetic peptide
  MOD_RES (14): Unknown amino acid
FHANFYDWFVRQVXGGSGGSGGSG

SEQ ID NO: 1533 - protein, 18 aa, Artificial Sequence
  Description of Artificial Sequence: Synthetic peptide
  MOD_RES (12): Unknown amino acid
YHENFYDWFVRXVSGGSG

SEQ ID NO: 1534 - protein, 22 aa, Artificial Sequence
  Description of Artificial Sequence: Synthetic peptide
FHENFYDWFVRQVSGGSGGSGG

SEQ ID NO: 1535 - protein, 25 aa, Artificial Sequence
  Description of Artificial Sequence: Synthetic peptide
FPENFYDWFDRQVSGGSGGSGGSSG

SEQ ID NO: 1536 - protein, 29 aa, Artificial Sequence
  Description of Artificial Sequence: Synthetic peptide
  MOD_RES (26): Unknown amino acid
FHENFYDWFVRQVSGGSGGSGGSHLXGSG

SEQ ID NO: 1537 - protein, 31 aa, Artificial Sequence; identical to SEQ ID NO: 1481
  Description of Artificial Sequence: Synthetic peptide
  MOD_RES (1): Unknown amino acid

SEQ ID NO: 1538 - protein, 43 aa, Artificial Sequence; identical to SEQ ID NO: 1482
  Description of Artificial Sequence: Synthetic peptide

SEQ ID NO: 1539 - protein, 29 aa, Artificial Sequence
  Description of Artificial Sequence: Synthetic peptide
  MOD_RES (26): Unknown amino acid
FPENFYDWFDRQVSGGSGGGASLFGXGSG

SEQ ID NO: 1540 - protein, 29 aa, Artificial Sequence
  Description of Artificial Sequence: Synthetic peptide
  MOD_RES (26): Unknown amino acid
FHDNFYDWFDRQVSGGSGGSGSPFGXRSD

SEQ ID NO: 1541 - protein, 23 aa, Artificial Sequence
  Description of Artificial Sequence: Synthetic peptide
DYKDLCQSWGVRIGWLAGLCPKK

SEQ ID NO: 1542 - protein, 17 aa, Artificial Sequence
  Description of Artificial Sequence: Synthetic peptide
LCQSWGVRIGWLAGLCP

SEQ ID NO: 1543 - protein, 8 aa, Artificial Sequence
  Description of Artificial Sequence: Synthetic peptide
  MOD_RES (2): Pro, Gly, Ser, Arg, Ala or Leu; preferably Pro
  MOD_RES (5): Any amino acid; preferably a charged or aromatic amino acid
  MOD_RES (7): Hydrophobic amino acid; preferably Leu or Phe
  MOD_RES (8): Any amino acid; preferably a small amino acid
WXGYXWXX

SEQ ID NO: 1544 - protein, 5 aa, Artificial Sequence
  Description of Artificial Sequence: Synthetic peptide
  MOD_RES (3): Any amino acid
FYXWF

SEQ ID NO: 1545 - protein, 4 aa, Artificial Sequence
  Description of Artificial Sequence: Synthetic peptide
DYKD

SEQ ID NO: 1546 - protein, 6 aa, Artificial Sequence
  Description of Artificial Sequence: Synthetic peptide
AAAGAP

SEQ ID NO: 1547 - protein, 8 aa, Artificial Sequence
  Description of Artificial Sequence: Synthetic peptide
DYKDDDDK

SEQ ID NO: 1548 - protein, 20 aa, Artificial Sequence
  Description of Artificial Sequence: Synthetic peptide
  MOD_RES (14): Tyr or Trp
SLEEEWAQIQCEIXGRGCRY

SEQ ID NO: 1549 - protein, 7 aa, Artificial Sequence
  Description of Artificial Sequence: Synthetic peptide
  MOD_RES (2): Ala or Glu
  MOD_RES (7): Phe or Leu
WXGYEWX

SEQ ID NO: 1550 - protein, 21 aa, Artificial Sequence
  Description of Artificial Sequence: Synthetic peptide
CWARPCGDAANFYDWFVQQAS

SEQ ID NO: 1551 - protein, 12 aa, Artificial Sequence
  Description of Artificial Sequence: Synthetic peptide
SAKNFYDWFVKK

SEQ ID NO: 1552 - protein, 19 aa, Artificial Sequence
  Description of Artificial Sequence: Synthetic peptide
PPWGARFYDAIEQLVFDNL

SEQ ID NO: 1553 - protein, 18 aa, Artificial Sequence
  Description of Artificial Sequence: Synthetic peptide
VMDARDDPFYHKLSELVT

SEQ ID NO: 1554 - protein, 5 aa, Artificial Sequence
  Description of Artificial Sequence: Synthetic peptide
FYDWF

SEQ ID NO: 1555 - protein, 5 aa, Artificial Sequence
  Description of Artificial Sequence: Synthetic peptide
FYEWF

SEQ ID NO: 1556 - protein, 16 aa, Artificial Sequence
  Description of Artificial Sequence: Synthetic peptide
FHENFYDWFVRQVSKK

SEQ ID NO: 1557 - protein, 14 aa, Artificial Sequence
  Description of Artificial Sequence: Synthetic peptide
FHENFYDWFVRQVS

SEQ ID NO: 1558 - protein, 18 aa, Artificial Sequence
  Description of Artificial Sequence: Synthetic peptide
GSLDESFYDWFERQLGKK

SEQ ID NO: 1559 - protein, 16 aa, Artificial Sequence
  Description of Artificial Sequence: Synthetic peptide
GSLDESFYDWFERQLG

SEQ ID NO: 1560 - protein, 21 aa, Artificial Sequence
  Description of Artificial Sequence: Synthetic peptide
GRVDWLQRNANFYDWFVAELG

SEQ ID NO: 1561 - protein, 16 aa, Artificial Sequence
  Description of Artificial Sequence: Synthetic peptide
GLADEDFYEWFERQLR

SEQ ID NO: 1562 - protein, 16 aa, Artificial Sequence
  Description of Artificial Sequence: Synthetic peptide
GLADELFYEWFDRQLS

SEQ ID NO: 1563 - protein, 16 aa, Artificial Sequence
  Description of Artificial Sequence: Synthetic peptide
GQLDEDFYEWFDRQLS

SEQ ID NO: 1564 - protein, 16 aa, Artificial Sequence
  Description of Artificial Sequence: Synthetic peptide
GQLDEDFYAWFDRQLS

SEQ ID NO: 1565 - protein, 16 aa, Artificial Sequence
  Description of Artificial Sequence: Synthetic peptide
GFMDESFYEWFERQLR

SEQ ID NO: 1566 - protein, 16 aa, Artificial Sequence
  Description of Artificial Sequence: Synthetic peptide
GFWDESFYAWFERQLR

SEQ ID NO: 1567 - protein, 16 aa, Artificial Sequence
  Description of Artificial Sequence: Synthetic peptide
GFMDESFYAWFERQLR

SEQ ID NO: 1568 - protein, 16 aa, Artificial Sequence
  Description of Artificial Sequence: Synthetic peptide
GFWDESFYEWFERQLR

SEQ ID NO: 1569 - protein, 8 aa, Artificial Sequence
  Description of Artificial Sequence: Synthetic peptide
  MOD_RES (3)..(4): Any amino acid
  MOD_RES (6)..(7): Any amino acid
FYXXLXXL

SEQ ID NO: 1570 - protein, 8 aa, Artificial Sequence
  Description of Artificial Sequence: Synthetic peptide
  MOD_RES (3)..(4): Any amino acid
  MOD_RES (6)..(7): Any amino acid
FYXXIXXL

SEQ ID NO: 1571 - protein, 8 aa, Artificial Sequence
  Description of Artificial Sequence: Synthetic peptide
  MOD_RES (3): Any amino acid
  MOD_RES (6)..(7): Any amino acid
FYXAIXXL

SEQ ID NO: 1572 - protein, 8 aa, Artificial Sequence
  Description of Artificial Sequence: Synthetic peptide
  MOD_RES (3): Any amino acid
  MOD_RES (6)..(7): Any amino acid
FYXYFXXL

SEQ ID NO: 1573 - protein, 8 aa, Artificial Sequence
  Description of Artificial Sequence: Synthetic peptide
  MOD_RES (3): Any amino acid
  MOD_RES (6)..(7): Any amino acid
FYXYFXXL

SEQ ID NO: 1574 - protein, 16 aa, Artificial Sequence
  Description of Artificial Sequence: Synthetic peptide
  MOD_RES (1)..(4): Any amino acid which allows for binding to IR or IGF-1R
  MOD_RES (7): Any amino acid
  MOD_RES (10)..(11): Any amino acid
  MOD_RES (13)..(16): Any amino acid which allows for binding to IR or IGF-1R
XXXXFYXYFXXLXXXX

SEQ ID NO: 1575 - protein, 20 aa, Artificial Sequence
  Description of Artificial Sequence: Synthetic peptide
  MOD_RES (1): Any amino acid
  MOD_RES (4)..(5): Any amino acid
  MOD_RES (7)..(9): Any amino acid
  MOD_RES (12)..(17): Any amino acid
  MOD_RES (19)..(20): Any amino acid
XLCXXEXXXWGXXXXXXCXX

SEQ ID NO: 1576 - protein, 20 aa, Artificial Sequence
  Description of Artificial Sequence: Synthetic peptide
HLCVLEELFWGASLFGYCSG

SEQ ID NO: 1577 - protein, 20 aa, Artificial Sequence
  Description of Artificial Sequence: Synthetic peptide
  MOD_RES (1)..(4): Any amino acid
  MOD_RES (8): Any hydrophobic amino acid
  MOD_RES (12): Any amino acid
  MOD_RES (13): Any hydrophobic amino acid
  MOD_RES (14)..(15): Any amino acid
  MOD_RES (17): Any amino acid
  MOD_RES (19)..(20): Any amino acid
XXXXLCEXFGGXXXXGXCXX

SEQ ID NO: 1578 - protein, 20 aa, Artificial Sequence
  Description of Artificial Sequence: Synthetic peptide
  MOD_RES (1): Any amino acid
  MOD_RES (3): Any polar amino acid; preferably Asp or Glu
  MOD_RES (4): Any amino acid
  MOD_RES (5): Any amino acid; strong preference for Glu
  MOD_RES (7)..(8): Any amino acid
  MOD_RES (9): Any amino acid; preferaby Val, Ile, Leu or Met
  MOD_RES (10): Any amino acid
  MOD_RES (12): Any amino acid
  MOD_RES (13): Any amino acid; preferably Val, Ile, Leu or Met
  MOD_RES (14): Any aromatic amino acid
  MOD_RES (15)..(17): Any amino acid
  MOD_RES (19)..(20): Any amino acid
XLXXXWXXXXCXXXXXXCXX

SEQ ID NO: 1579 - protein, 23 aa, Artificial Sequence
  Description of Artificial Sequence: Synthetic peptide
KWLDQEWAWVQCEVYGRGCPSKK

SEQ ID NO: 1580 - protein, 21 aa, Artificial Sequence
  Description of Artificial Sequence: Synthetic peptide
KWLDQEWAWVQCEVYGRGCPS

SEQ ID NO: 1581 - protein, 20 aa, Artificial Sequence
  Description of Artificial Sequence: Synthetic peptide
SLEEEWAQIQCEIYGRGCRY

SEQ ID NO: 1582 - protein, 20 aa, Artificial Sequence
  Description of Artificial Sequence: Synthetic peptide
SLEEEWAQIQCEIWGRGCRY

SEQ ID NO: 1583 - protein, 20 aa, Artificial Sequence
  Description of Artificial Sequence: Synthetic peptide
SLEEEWAQIECEVYGRGCPS

SEQ ID NO: 1584 - protein, 20 aa, Artificial Sequence
  Description of Artificial Sequence: Synthetic peptide
SLEEEWAQIECEVWGRGCPS

SEQ ID NO: 1585 - protein, 12 aa, Artificial Sequence
  Description of Artificial Sequence: Synthetic peptide
  MOD_RES (6): Any amino acid; preferably a polar amino acid
  MOD_RES (8)..(10): Any amino acid
HPPLSXLXXXLL

SEQ ID NO: 1586 - protein, 5 aa, Artificial Sequence
  Description of Artificial Sequence: Synthetic peptide
WPTYW

SEQ ID NO: 1587 - protein, 11 aa, Artificial Sequence
  Description of Artificial Sequence: Synthetic peptide
ACVWPTYWNCG

SEQ ID NO: 1588 - protein, 4 aa, Artificial Sequence
  Description of Artificial Sequence: Synthetic peptide
WPGY

SEQ ID NO: 1589 - protein, 23 aa, Artificial Sequence
  Description of Artificial Sequence: Synthetic peptide
KVRGFQGGTVWPGYEWLRNAAKK

SEQ ID NO: 1590 - protein, 21 aa, Artificial Sequence
  Description of Artificial Sequence: Synthetic peptide
KVRGFQGGTVWPGYEWLRNAA

SEQ ID NO: 1591 - protein, 7 aa, Artificial Sequence
  Description of Artificial Sequence: Synthetic peptide
WAGYEWF

SEQ ID NO: 1592 - protein, 7 aa, Artificial Sequence
  Description of Artificial Sequence: Synthetic peptide
WEGYEWL

SEQ ID NO: 1593 - protein, 7 aa, Artificial Sequence
  Description of Artificial Sequence: Synthetic peptide
WAGYEWL

SEQ ID NO: 1594 - protein, 7 aa, Artificial Sequence
  Description of Artificial Sequence: Synthetic peptide
WEGYEWF

SEQ ID NO: 1595 - protein, 15 aa, Artificial Sequence
  Description of Artificial Sequence: Synthetic peptide
DSDWAGYEWFEEQLD

SEQ ID NO: 1596 - protein, 5 aa, Artificial Sequence
  Description of Artificial Sequence: Synthetic peptide
  MOD_RES (3): Any amino acid
FYXWF

SEQ ID NO: 1597 - protein, 4 aa, Artificial Sequence
  Description of Artificial Sequence: Synthetic peptide
VYGR

SEQ ID NO: 1598 - protein, 4 aa, Artificial Sequence
  Description of Artificial Sequence: Synthetic peptide
EQLD

SEQ ID NO: 1599 - protein, 39 aa, Artificial Sequence; identical to SEQ ID NO: 214
  Description of Artificial Sequence: Synthetic peptide

SEQ ID NO: 1600 - protein, 26 aa, Artificial Sequence
  Description of Artificial Sequence: Synthetic peptide
GIISQSCPESFYDWFAGQVSDPWWCW

SEQ ID NO: 1601 - protein, 26 aa, Artificial Sequence
  Description of Artificial Sequence: Synthetic peptide
VGRASGFPENFYDWFGRQLSLQSGEQ

SEQ ID NO: 1602 - protein, 38 aa, Artificial Sequence
  Description of Artificial Sequence: Synthetic peptide
YRGMLVLGRISDGAGVASEPPARIGRKVFAVNFYDWFV

SEQ ID NO: 1603 - protein, 39 aa, Artificial Sequence; identical to SEQ ID NO: 216
  Description of Artificial Sequence: Synthetic peptide

SEQ ID NO: 1604 - protein, 26 aa, Artificial Sequence
  Description of Artificial Sequence: Synthetic peptide
VGYQGQGDENFYDWFIRQVSGRLGVQ

SEQ ID NO: 1605 - protein, 26 aa, Artificial Sequence
  Description of Artificial Sequence: Synthetic peptide
SACQFDCHENFYDWFARQVSGGAAYG

SEQ ID NO: 1606 - protein, 26 aa, Artificial Sequence
  Description of Artificial Sequence: Synthetic peptide
SAAQLFFQESFYDWFLRQVAESSQPN

SEQ ID NO: 1607 - protein, 26 aa, Artificial Sequence
  Description of Artificial Sequence: Synthetic peptide
AVRATRFDEAFYDWFVRQISDGQGNK

SEQ ID NO: 1608 - protein, 26 aa, Artificial Sequence
  Description of Artificial Sequence: Synthetic peptide
VNQSGSIHENFYDWFERQVSHQRGVR

SEQ ID NO: 1609 - protein, 26 aa, Artificial Sequence
  Description of Artificial Sequence: Synthetic peptide
APDPSDFQEIFYDWFVRQVSRMPGGG

SEQ ID NO: 1610 - protein, 25 aa, Artificial Sequence
  Description of Artificial Sequence: Synthetic peptide
SSCDGAGHESFYEWFVRQVSGCRSV

SEQ ID NO: 1611 - protein, 26 aa, Artificial Sequence
  Description of Artificial Sequence: Synthetic peptide
RAGSSDFHEDFYEWFVRQVSLSLKGK

SEQ ID NO: 1612 - protein, 26 aa, Artificial Sequence
  Description of Artificial Sequence: Synthetic peptide
QAVQPGFHEEFYDWFVRQVSTGVGGG

SEQ ID NO: 1613 - protein, 16 aa, Artificial Sequence
  Description of Artificial Sequence: Synthetic peptide
GFREGNFYEWFQAQVT

SEQ ID NO: 1614 - protein, 26 aa, Artificial Sequence
  Description of Artificial Sequence: Synthetic peptide
SSIGGGFHENFYDWFSRQLSQSPPLK

SEQ ID NO: 1615 - protein, 26 aa, Artificial Sequence
  Description of Artificial Sequence: Synthetic peptide
QSPVGSSHEDFYDWFFRQVAQSGAHQ

SEQ ID NO: 1616 - protein, 26 aa, Artificial Sequence
  Description of Artificial Sequence: Synthetic peptide
NYRRQVFNGNFYDWFDRQVFSLVTPG

SEQ ID NO: 1617 - protein, 26 aa, Artificial Sequence
  Description of Artificial Sequence: Synthetic peptide
TLDGGSFEEQFYDWFVRQLSYRTNPD

SEQ ID NO: 1618 - protein, 26 aa, Artificial Sequence
  Description of Artificial Sequence: Synthetic peptide
FYVQQWGHENFYDWFDRQVSQSGGAG

SEQ ID NO: 1619 - protein, 26 aa, Artificial Sequence
  Description of Artificial Sequence: Synthetic peptide
LRRQAPVEENFYDWFVRQVSGDRVGG

SEQ ID NO: 1620 - protein, 26 aa, Artificial Sequence
  Description of Artificial Sequence: Synthetic peptide
RCGRELYHSTFYDWFDRQVAGRTCPS

SEQ ID NO: 1621 - protein, 26 aa, Artificial Sequence
  Description of Artificial Sequence: Synthetic peptide
CCLLCRFQQNFYDWFVCQGISRLRPL

SEQ ID NO: 1622 - protein, 26 aa, Artificial Sequence
  Description of Artificial Sequence: Synthetic peptide
PPLASDLDVQFYGWFVQQVSPPGRGG

SEQ ID NO: 1623 - protein, 25 aa, Artificial Sequence
  Description of Artificial Sequence: Synthetic peptide
GAPVDQLHEDFYDWFVRQVSQAATG

SEQ ID NO: 1624 - protein, 16 aa, Artificial Sequence
  Description of Artificial Sequence: Synthetic peptide
GFREGSFYDWFQAQVT

SEQ ID NO: 1625 - protein, 21 aa, Artificial Sequence
  Description of Artificial Sequence: Synthetic peptide
SQAGSAFYAWFDQVLRTVHSA

SEQ ID NO: 1626 - protein, 26 aa, Artificial Sequence
  Description of Artificial Sequence: Synthetic peptide
RGAVAGFHDQFYDWFDRQVSRVHKFG

SEQ ID NO: 1627 - protein, 26 aa, Artificial Sequence
  Description of Artificial Sequence: Synthetic peptide
AICDAGFHEHFYDWFALQVSDCGRQS

SEQ ID NO: 1628 - protein, 26 aa, Artificial Sequence
  Description of Artificial Sequence: Synthetic peptide
LGYQEPFQQNFYDWFVRQVSGAENAG

SEQ ID NO: 1629 - protein, 21 aa, Artificial Sequence
  Description of Artificial Sequence: Synthetic peptide
EAASLGSQDRNFYDWFVRQVV

SEQ ID NO: 1630 - protein, 21 aa, Artificial Sequence
  Description of Artificial Sequence: Synthetic peptide
VERSASSQDGNFYDWFVVQIR

SEQ ID NO: 1631 - protein, 21 aa, Artificial Sequence
  Description of Artificial Sequence: Synthetic peptide
TSEVQRRSQDNFYDWFVAQVA

SEQ ID NO: 1632 - protein, 26 aa, Artificial Sequence
  Description of Artificial Sequence: Synthetic peptide
HLADGQFHEKFYDWFERQISSRCNDC

SEQ ID NO: 1633 - protein, 26 aa, Artificial Sequence
  Description of Artificial Sequence: Synthetic peptide
FRTLAAQHDSFYDWFDRQVSGAAGER

SEQ ID NO: 1634 - protein, 20 aa, Artificial Sequence
  Description of Artificial Sequence: Synthetic peptide
SFHEDFYDWFDRQVSGSLKK

SEQ ID NO: 1635 - protein, 25 aa, Artificial Sequence
  Description of Artificial Sequence: Synthetic peptide
TFYSCLASLLTGTPQPNRGPWERCR

SEQ ID NO: 1636 - protein, 25 aa, Artificial Sequence
  Description of Artificial Sequence: Synthetic peptide
FFYDCLAALLQGVARYHDLCAVEIT

SEQ ID NO: 1637 - protein, 27 aa, Artificial Sequence
  Description of Artificial Sequence: Synthetic peptide
CCTTEMVVMDARDDPFYHKLSELVTGG

SEQ ID NO: 1638 - protein, 20 aa, Artificial Sequence
  Description of Artificial Sequence: Synthetic peptide
RGQSDAFYSGLWALIGLSDG

SEQ ID NO: 1639 - protein, 21 aa, Artificial Sequence
  Description of Artificial Sequence: Synthetic peptide
GVRAMSFYDALVSVLGLGPSG

SEQ ID NO: 1640 - protein, 20 aa, Artificial Sequence
  Description of Artificial Sequence: Synthetic peptide
RLFYCGIQALGANLGYSGCV

SEQ ID NO: 1641 - protein, 21 aa, Artificial Sequence
  Description of Artificial Sequence: Synthetic peptide
LQPCSGFYECIERLIGVKLSG

SEQ ID NO: 1642 - protein, 17 aa, Artificial Sequence
  Description of Artificial Sequence: Synthetic peptide
LKDGFYDYFWQRLHLGS

SEQ ID NO: 1643 - protein, 21 aa, Artificial Sequence
  Description of Artificial Sequence: Synthetic peptide
VEGRGLFYDLLRQLLARRQNG

SEQ ID NO: 1644 - protein, 27 aa, Artificial Sequence
  Description of Artificial Sequence: Synthetic peptide
RGCNDDGGKGWSDDPFYHKLSELICGG

SEQ ID NO: 1645 - protein, 21 aa, Artificial Sequence
  Description of Artificial Sequence: Synthetic peptide
QGGSASFYDAIDRLLRMRIGG

SEQ ID NO: 1646 - protein, 27 aa, Artificial Sequence
  Description of Artificial Sequence: Synthetic peptide
RCEEKQAEVGPSSDPFYHKMSELLGCR

SEQ ID NO: 1647 - protein, 25 aa, Artificial Sequence
  Description of Artificial Sequence: Synthetic peptide
DRDFCRFYERLTALVGGQVDGGWPC

SEQ ID NO: 1648 - protein, 21 aa, Artificial Sequence
  Description of Artificial Sequence: Synthetic peptide
KLHNLMFYYGLQRLVWGAGLG

SEQ ID NO: 1649 - protein, 21 aa, Artificial Sequence
  Description of Artificial Sequence: Synthetic peptide
GNGDGMFYQLLSLLVGRDMHV

SEQ ID NO: 1650 - protein, 25 aa, Artificial Sequence
  Description of Artificial Sequence: Synthetic peptide
SSYGCDGFYLMLFSLGLVASQELEC

SEQ ID NO: 1651 - protein, 21 aa, Artificial Sequence
  Description of Artificial Sequence: Synthetic peptide
PDLHKGFYAQLAQLIRGQLLS

SEQ ID NO: 1652 - protein, 20 aa, Artificial Sequence
  Description of Artificial Sequence: Synthetic peptide
FYDAIDQLVRGSARAGGTRD

SEQ ID NO: 1653 - protein, 21 aa, Artificial Sequence
  Description of Artificial Sequence: Synthetic peptide
YSCGDGFYSLLSDLLGGQFRC

SEQ ID NO: 1654 - protein, 27 aa, Artificial Sequence
  Description of Artificial Sequence: Synthetic peptide
RGMKEEVLVGGSTDPFYHKLSELLQGS

SEQ ID NO: 1655 - protein, 21 aa, Artificial Sequence
  Description of Artificial Sequence: Synthetic peptide
IQQELTFYDLLHRLVRSELGS

SEQ ID NO: 1656 - protein, 21 aa, Artificial Sequence
  Description of Artificial Sequence: Synthetic peptide
GGTEVDFYRALERLVRGQLGL

SEQ ID NO: 1657 - protein, 20 aa, Artificial Sequence
  Description of Artificial Sequence: Synthetic peptide
LRIANLFYQRLWDLAFGGGG

SEQ ID NO: 1658 - protein, 26 aa, Artificial Sequence
  Description of Artificial Sequence: Synthetic peptide
  MOD_RES (6): Unknown amino acid; translation read-through at TGA stop codon
RCGRWXAEMGAGDDPFYHKLSELVCG

SEQ ID NO: 1659 - protein, 20 aa, Artificial Sequence
  Description of Artificial Sequence: Synthetic peptide
DRAFYNGLRDLVGAVYGAWD

SEQ ID NO: 1660 - protein, 21 aa, Artificial Sequence
  Description of Artificial Sequence: Synthetic peptide
PVGVQGFYEGLSRLVLGRGGW

SEQ ID NO: 1661 - protein, 21 aa, Artificial Sequence
  Description of Artificial Sequence: Synthetic peptide
RFSTDGFYQYLLALVGGGPVG

SEQ ID NO: 1662 - protein, 21 aa, Artificial Sequence
  Description of Artificial Sequence: Synthetic peptide
NSRDGGFYLQLERLLGFPVTG

SEQ ID NO: 1663 - protein, 21 aa, Artificial Sequence
  Description of Artificial Sequence: Synthetic peptide
  MOD_RES (18): Unknown amino acid
VVTPVNFYRALEALVRGXRLG

SEQ ID NO: 1664 - protein, 21 aa, Artificial Sequence
  Description of Artificial Sequence: Synthetic peptide
QPAPDGFYSALMKLIGRGGVS

SEQ ID NO: 1665 - protein, 21 aa, Artificial Sequence
  Description of Artificial Sequence: Synthetic peptide
PGTDLGFYQALRCVVIQGACD

SEQ ID NO: 1666 - protein, 21 aa, Artificial Sequence
  Description of Artificial Sequence: Synthetic peptide
AQPCGGFYGLLEQLVGRSVCD

SEQ ID NO: 1667 - protein, 21 aa, Artificial Sequence
  Description of Artificial Sequence: Synthetic peptide
QPDHSYFYSLLQELVGSEERL

SEQ ID NO: 1668 - protein, 25 aa, Artificial Sequence
  Description of Artificial Sequence: Synthetic peptide
QFYGCLLDLSLGVPSFGWRRRCITA

SEQ ID NO: 1669 - protein, 21 aa, Artificial Sequence
  Description of Artificial Sequence: Synthetic peptide
LGVTDGFYAALGYLIHGVGQF

SEQ ID NO: 1670 - protein, 21 aa, Artificial Sequence
  Description of Artificial Sequence: Synthetic peptide
  MOD_RES (4): Unknown amino acid
CMMXDGFYAGLGCLLTAGEGR

SEQ ID NO: 1671 - protein, 21 aa, Artificial Sequence
  Description of Artificial Sequence: Synthetic peptide
ICTGQGFYQVLCGLLRGTSAR

SEQ ID NO: 1672 - protein, 21 aa, Artificial Sequence
  Description of Artificial Sequence: Synthetic peptide
QGNVLDFYGWIGRLLAKQGSD

SEQ ID NO: 1673 - protein, 21 aa, Artificial Sequence
  Description of Artificial Sequence: Synthetic peptide
VATSQGFYSGLSELLQGGGNV

SEQ ID NO: 1674 - protein, 21 aa, Artificial Sequence
  Description of Artificial Sequence: Synthetic peptide
IWATGDFYRLLSQLVMGRVGT

SEQ ID NO: 1675 - protein, 17 aa, Artificial Sequence
  Description of Artificial Sequence: Synthetic peptide
EGSGFYGYFFSLLGLQG

SEQ ID NO: 1676 - protein, 21 aa, Artificial Sequence
  Description of Artificial Sequence: Synthetic peptide
RQGTGSFYLMLEQLLVGARGP

SEQ ID NO: 1677 - protein, 21 aa, Artificial Sequence
  Description of Artificial Sequence: Synthetic peptide
DSVGDNFYQLLESLVGGHGVG

SEQ ID NO: 1678 - protein, 30 aa, Artificial Sequence
  Description of Artificial Sequence: Synthetic peptide
RGIVAMVEATEVGSDHDPFYHKLSELVQGS

SEQ ID NO: 1679 - protein, 21 aa, Artificial Sequence
  Description of Artificial Sequence: Synthetic peptide
LSSDGQFYRALNLLLQGSAGR

SEQ ID NO: 1680 - protein, 21 aa, Artificial Sequence
  Description of Artificial Sequence: Synthetic peptide
ASSASGFYELLQRLAGLGLEV

SEQ ID NO: 1681 - protein, 25 aa, Artificial Sequence
  Description of Artificial Sequence: Synthetic peptide
FFYRCLSRLLGGQLGSRLGLSCIGD

SEQ ID NO: 1682 - protein, 17 aa, Artificial Sequence
  Description of Artificial Sequence: Synthetic peptide
IIGGFYSYFNSVLRLGT

SEQ ID NO: 1683 - protein, 21 aa, Artificial Sequence
  Description of Artificial Sequence: Synthetic peptide
PAGPCGFYCGLGLLLHGDQSP

SEQ ID NO: 1684 - protein, 21 aa, Artificial Sequence
  Description of Artificial Sequence: Synthetic peptide
RCQGTGFYTCIQELIGFGDPD

SEQ ID NO: 1685 - protein, 27 aa, Artificial Sequence
  Description of Artificial Sequence: Synthetic peptide
SGAKVIVVTGDSGDPFYHKLSELLQGS

SEQ ID NO: 1686 - protein, 21 aa, Artificial Sequence
  Description of Artificial Sequence: Synthetic peptide
VGTVAGFYDAIAQLVARASRV

SEQ ID NO: 1687 - protein, 21 aa, Artificial Sequence
  Description of Artificial Sequence: Synthetic peptide
TLRSPTFYDWLEMVLTHGQGG

SEQ ID NO: 1688 - protein, 17 aa, Artificial Sequence
  Description of Artificial Sequence: Synthetic peptide
RFDPFYSYFVNLLGASA

SEQ ID NO: 1689 - protein, 27 aa, Artificial Sequence
  Description of Artificial Sequence: Synthetic peptide
RGKTAAVIVGRPADPFYHKLSELLQGG

SEQ ID NO: 1690 - protein, 27 aa, Artificial Sequence
  Description of Artificial Sequence: Synthetic peptide
GCVVEWQKWHGASDPFYHKLSELGGCS

SEQ ID NO: 1691 - protein, 27 aa, Artificial Sequence
  Description of Artificial Sequence: Synthetic peptide
GRTMAVMAAGGPDDPFYHKLSELVQGG

SEQ ID NO: 1692 - protein, 27 aa, Artificial Sequence
  Description of Artificial Sequence: Synthetic peptide
GCAVVEEAERSRGDPFYHKLSELIQGC

SEQ ID NO: 1693 - protein, 26 aa, Artificial Sequence
  Description of Artificial Sequence: Synthetic peptide
GCEVIVEEGDSADPFYHKLSELCQGS

SEQ ID NO: 1694 - protein, 21 aa, Artificial Sequence
  Description of Artificial Sequence: Synthetic peptide
MMVVDGFYDALHQLVVAQSLG

SEQ ID NO: 1695 - protein, 21 aa, Artificial Sequence
  Description of Artificial Sequence: Synthetic peptide
LSVALSFYDALGQLVAGEGRW

SEQ ID NO: 1696 - protein, 27 aa, Artificial Sequence
  Description of Artificial Sequence: Synthetic peptide
GGTKAVAKVGTRDDPFYHKLSELLQGS

SEQ ID NO: 1697 - protein, 40 aa, Artificial Sequence
  Description of Artificial Sequence: Synthetic peptide
AETSVQVGWIRLQSVWPGEHWNTVDPFYHKLSELLRGSGA

SEQ ID NO: 1698 - protein, 27 aa, Artificial Sequence
  Description of Artificial Sequence: Synthetic peptide
SRAKVEAEMPDSGDPFYHKLSELLASG

SEQ ID NO: 1699 - protein, 27 aa, Artificial Sequence
  Description of Artificial Sequence: Synthetic peptide
SRVAATKEKRPSDDPFYHKLSELLQGS

SEQ ID NO: 1700 - protein, 27 aa, Artificial Sequence
  Description of Artificial Sequence: Synthetic peptide
SSETAKMVTGTRDDPFYHKLSELVQGS

SEQ ID NO: 1701 - protein, 24 aa, Artificial Sequence
  Description of Artificial Sequence: Synthetic peptide
GCITAENGAGDPFYHKLSELGGCS

SEQ ID NO: 1702 - protein, 28 aa, Artificial Sequence
  Description of Artificial Sequence: Synthetic peptide
RCGDEEGWQENRRDDPFYHKLSELFGGC

SEQ ID NO: 1703 - protein, 21 aa, Artificial Sequence
  Description of Artificial Sequence: Synthetic peptide
MNVFVSFYDAIDQLVCQRIGC

SEQ ID NO: 1704 - protein, 21 aa, Artificial Sequence
  Description of Artificial Sequence: Synthetic peptide
QSGSGDFYDWLSRLIRGNGDG

SEQ ID NO: 1705 - protein, 24 aa, Artificial Sequence
  Description of Artificial Sequence: Synthetic peptide
CGAKMTGTPNDPFYHKLSELLQRG

SEQ ID NO: 1706 - protein, 21 aa, Artificial Sequence
  Description of Artificial Sequence: Synthetic peptide
GHYFGSFYDAIDQLVAGMLPG

SEQ ID NO: 1707 - protein, 40 aa, Artificial Sequence
  Description of Artificial Sequence: Synthetic peptide
  MOD_RES (9): Unknown amino acid; translation read-through at TGA stop codon
AGTPAQVGXNRLWSVWPGEHWNTVDPFYNKLSELLRESGA

SEQ ID NO: 1708 - protein, 27 aa, Artificial Sequence
  Description of Artificial Sequence: Synthetic peptide
CSMAAVAEAGDDDDPFYHKLSELCQGS

SEQ ID NO: 1709 - protein, 40 aa, Artificial Sequence
  Description of Artificial Sequence: Synthetic peptide
  MOD_RES (30): Unknown amino acid; translation read-through at TGA stop codon
VDTPAQVGWNRLWSVGPGEHWYTDDPFYHXLSELLRESGA

SEQ ID NO: 1710 - protein, 40 aa, Artificial Sequence
  Description of Artificial Sequence: Synthetic peptide
AETSAQVGWQRLWSVWPGDHWSTLDPFYHKLSELLRESGA

SEQ ID NO: 1711 - protein, 21 aa, Artificial Sequence
  Description of Artificial Sequence: Synthetic peptide
AGSVTSFYDAMEQLVATGTSA

SEQ ID NO: 1712 - protein, 18 aa, Artificial Sequence
  Description of Artificial Sequence: Synthetic peptide
TDDGFYDALEQLVQGSKK

SEQ ID NO: 1713 - protein, 18 aa, Artificial Sequence
  Description of Artificial Sequence: Synthetic peptide
GSFYEALQRLVGGEQGKK

SEQ ID NO: 1714 - protein, 20 aa, Artificial Sequence
  Description of Artificial Sequence: Synthetic peptide
VRGFQGGTVWPGYEWLRNAA

SEQ ID NO: 1715 - protein, 40 aa, Artificial Sequence; identical to SEQ ID NO: 1109
  Description of Artificial Sequence: Synthetic peptide

SEQ ID NO: 1716 - protein, 39 aa, Artificial Sequence
  Description of Artificial Sequence: Synthetic peptide
GLDHSDAVGVHLGFAWPAQARGRWEAGGLEDTWAGYDWL

SEQ ID NO: 1717 - protein, 8 aa, Artificial Sequence
  Description of Artificial Sequence: Synthetic peptide
  MOD_RES (2): Unknown amino acid
WXGYAWLS

SEQ ID NO: 1718 - protein, 23 aa, Artificial Sequence
  Description of Artificial Sequence: Synthetic peptide
KRGGGTFYEWFESALRKHGAGKK

SEQ ID NO: 1719 - protein, 23 aa, Artificial Sequence
  Description of Artificial Sequence: Synthetic peptide
VTFTSAVFHENFYDWFVRQVSKK

SEQ ID NO: 1720 - protein, 21 aa, Artificial Sequence
  Description of Artificial Sequence: Synthetic peptide
NGVERAGTGDNFYDWFVAQLH

SEQ ID NO: 1721 - protein, 21 aa, Artificial Sequence
  Description of Artificial Sequence: Synthetic peptide
QSDSGTVHDRFYGWFRDTWAS

SEQ ID NO: 1722 - protein, 21 aa, Artificial Sequence
  Description of Artificial Sequence: Synthetic peptide
GRFYGWFQDAIDQLMPWGFDP

SEQ ID NO: 1723 - protein, 17 aa, Artificial Sequence
  Description of Artificial Sequence: Synthetic peptide
RYGRWGLAQQFYDWFDR

SEQ ID NO: 1724 - protein, 16 aa, Artificial Sequence
  Description of Artificial Sequence: Synthetic peptide
GFREGQRWYWFVAQVT

SEQ ID NO: 1725 - protein, 26 aa, Artificial Sequence
  Description of Artificial Sequence: Synthetic peptide
TYKARFLHENFYDWFNRQVSQYFGRV

SEQ ID NO: 1726 - protein, 21 aa, Artificial Sequence
  Description of Artificial Sequence: Synthetic peptide
WTDVDGFHSGFYRWFQNQWER

SEQ ID NO: 1727 - protein, 21 aa, Artificial Sequence
  Description of Artificial Sequence: Synthetic peptide
VASGHVLHGQFYRWFVDQFAL

SEQ ID NO: 1728 - protein, 21 aa, Artificial Sequence
  Description of Artificial Sequence: Synthetic peptide
QARVGNVHQQFYEWFREVMQG

SEQ ID NO: 1729 - protein, 21 aa, Artificial Sequence
  Description of Artificial Sequence: Synthetic peptide
TGHRLGLDEQFYWWFRDALSG

SEQ ID NO: 1730 - protein, 21 aa, Artificial Sequence
  Description of Artificial Sequence: Synthetic peptide
VGDFCVSHDCFYGWFLRESMQ

SEQ ID NO: 1731 - protein, 21 aa, Artificial Sequence
  Description of Artificial Sequence: Synthetic peptide
RMYFSTGAPQNFYDWFVQEWD

SEQ ID NO: 1732 - protein, 8 aa, Artificial Sequence
  Description of Artificial Sequence: Synthetic peptide
  MOD_RES (3)..(4): Unknown amino acid
  MOD_RES (6)..(7): Unknown amino acid
FYXXLXXL

SEQ ID NO: 1733 - protein, 23 aa, Artificial Sequence
  Description of Artificial Sequence: Synthetic peptide
KDRAFYNGLRDLVGAVYGAWDKK

SEQ ID NO: 1734 - protein, 26 aa, Artificial Sequence
  Description of Artificial Sequence: Synthetic peptide
DYKDFYDAIDQLVRGSARAGGTRDKK

SEQ ID NO: 1735 - protein, 21 aa, Artificial Sequence
  Description of Artificial Sequence: Synthetic peptide
EHWNTVDPFYFTLFEWLRESG

SEQ ID NO: 1736 - protein, 21 aa, Artificial Sequence
  Description of Artificial Sequence: Synthetic peptide
EHWNTVDPFYQYFSELLRESG

SEQ ID NO: 1737 - protein, 21 aa, Artificial Sequence
  Description of Artificial Sequence: Synthetic peptide
AGVNAGFYRYFSTLLDWWDQG

SEQ ID NO: 1738 - protein, 21 aa, Artificial Sequence
  Description of Artificial Sequence: Synthetic peptide
IQGWEPFYGWFDDVVAQMFEE

SEQ ID NO: 1739 - protein, 21 aa, Artificial Sequence
  Description of Artificial Sequence: Synthetic peptide
PPWGARFYDAIEQLVFDNLCC

SEQ ID NO: 1740 - protein, 17 aa, Artificial Sequence
  Description of Artificial Sequence: Synthetic peptide
RWPNFYGYFESLLTHFS

SEQ ID NO: 1741 - protein, 17 aa, Artificial Sequence
  Description of Artificial Sequence: Synthetic peptide
HYNAFYEYFQVLLAETW

SEQ ID NO: 1742 - protein, 21 aa, Artificial Sequence
  Description of Artificial Sequence: Synthetic peptide
IGRVRSFYDAIDKLFQSDWER

SEQ ID NO: 1743 - protein, 17 aa, Artificial Sequence
  Description of Artificial Sequence: Synthetic peptide
EGWDFYSYFSGLLASVT

SEQ ID NO: 1744 - protein, 21 aa, Artificial Sequence
  Description of Artificial Sequence: Synthetic peptide
SVKEVQFYRYFYDLLQSEESG

SEQ ID NO: 1745 - protein, 21 aa, Artificial Sequence
  Description of Artificial Sequence: Synthetic peptide
GNSGGSFYRYFQLLLDSDGMS

SEQ ID NO: 1746 - protein, 21 aa, Artificial Sequence
  Description of Artificial Sequence: Synthetic peptide
RDAGSSFYDAIDQLVCLTYFC

SEQ ID NO: 1747 - protein, 8 aa, Artificial Sequence
  Description of Artificial Sequence: Synthetic peptide
  MOD_RES (2)..(3): Unknown amino acid
  MOD_RES (5)..(6): Unknown amino acid
LXXLXXYF

SEQ ID NO: 1748 - protein, 17 aa, Artificial Sequence
  Description of Artificial Sequence: Synthetic peptide
LDALDRLMRYFEERPSL

SEQ ID NO: 1749 - protein, 20 aa, Artificial Sequence
  Description of Artificial Sequence: Synthetic peptide
PLAELWAYFEHSEQGRSSAH

SEQ ID NO: 1750 - protein, 17 aa, Artificial Sequence
  Description of Artificial Sequence: Synthetic peptide
LDPLDALLQYFWSVPGH

SEQ ID NO: 1751 - protein, 17 aa, Artificial Sequence
  Description of Artificial Sequence: Synthetic peptide
RGRLGSLSTQFYNWFAE

SEQ ID NO: 1752 - protein, 17 aa, Artificial Sequence
  Description of Artificial Sequence: Synthetic peptide
ADELEWLLDYFMHQPRP

SEQ ID NO: 1753 - protein, 17 aa, Artificial Sequence
  Description of Artificial Sequence: Synthetic peptide
DGVLEELFSYFSATVGP

SEQ ID NO: 1754 - protein, 7 aa, Artificial Sequence
  Description of Artificial Sequence: Synthetic peptide
  MOD_RES (3): Unknown amino acid
  MOD_RES (5): Unknown amino acid
WPXYXWL

SEQ ID NO: 1755 - protein, 20 aa, Artificial Sequence
  Description of Artificial Sequence: Synthetic peptide
WPGYLFFEEALQDWRGSTED

SEQ ID NO: 1756 - protein, 17 aa, Artificial Sequence
  Description of Artificial Sequence: Synthetic peptide
AAVHEQFYDWFADQYKK

SEQ ID NO: 1757 - protein, 17 aa, Artificial Sequence
  Description of Artificial Sequence: Synthetic peptide
QAPSNFYDWFVREWDKK

SEQ ID NO: 1758 - protein, 17 aa, Artificial Sequence
  Description of Artificial Sequence: Synthetic peptide
QSFYDYIEELLGGEWKK

SEQ ID NO: 1759 - protein, 17 aa, Artificial Sequence
  Description of Artificial Sequence: Synthetic peptide
DPFYQGLWEWLRESGKK

SEQ ID NO: 1760 - protein, 20 aa, Artificial Sequence
  Description of Artificial Sequence: Synthetic peptide
HLCVLEELFWGASLFGYCSG

SEQ ID NO: 1761 - protein, 20 aa, Artificial Sequence
  Description of Artificial Sequence: Synthetic peptide
FQSLLEELVWGAPLFRYGTG

SEQ ID NO: 1762 - protein, 20 aa, Artificial Sequence
  Description of Artificial Sequence: Synthetic peptide
PLCVLEELFWGASLFGYCSG

SEQ ID NO: 1763 - protein, 20 aa, Artificial Sequence
  Description of Artificial Sequence: Synthetic peptide
PLCVLEELFWGASLFGQCSG

SEQ ID NO: 1764 - protein, 20 aa, Artificial Sequence
  Description of Artificial Sequence: Synthetic peptide
HLCVLEELFWGASLFGQCSG

SEQ ID NO: 1765 - protein, 20 aa, Artificial Sequence
  Description of Artificial Sequence: Synthetic peptide
DLRVLCELFGGAYVLGYCSE

SEQ ID NO: 1766 - protein, 20 aa, Artificial Sequence
  Description of Artificial Sequence: Synthetic peptide
HRSVLKQLSWGASLFGQWAG

SEQ ID NO: 1767 - protein, 20 aa, Artificial Sequence
  Description of Artificial Sequence: Synthetic peptide
HLSVGEELSWWVALLGQWAR

SEQ ID NO: 1768 - protein, 20 aa, Artificial Sequence
  Description of Artificial Sequence: Synthetic peptide
APVSTEELRWGALLFGQWAG

SEQ ID NO: 1769 - protein, 23 aa, Artificial Sequence
  Description of Artificial Sequence: Synthetic peptide
KWLDQEWAWVQCEVYGRGCPSKK

SEQ ID NO: 1770 - protein, 20 aa, Artificial Sequence
  Description of Artificial Sequence: Synthetic peptide
QLEEEWAGVQCEVYGRECPS

SEQ ID NO: 1771 - protein, 20 aa, Artificial Sequence
  Description of Artificial Sequence: Synthetic peptide
ALEEEWAWVQVRSIRSGLPL

SEQ ID NO: 1772 - protein, 20 aa, Artificial Sequence
  Description of Artificial Sequence: Synthetic peptide
SLDQEWAWVQCEVYGRGCLS

SEQ ID NO: 1773 - protein, 20 aa, Artificial Sequence
  Description of Artificial Sequence: Synthetic peptide
WLEHEWAQIQCELYGRGCTY

SEQ ID NO: 1774 - protein, 20 aa, Artificial Sequence
  Description of Artificial Sequence: Synthetic peptide
GLEQGCPWVGLEVQCRGCPS

SEQ ID NO: 1775 - protein, 20 aa, Artificial Sequence
  Description of Artificial Sequence: Synthetic peptide
DLRVLCELFGGAYVLGYCSE

SEQ ID NO: 1776 - protein, 20 aa, Artificial Sequence
  Description of Artificial Sequence: Synthetic peptide
PLWGLCELFGGASLFGYCSS

SEQ ID NO: 1777 - protein, 12 aa, Artificial Sequence
  Description of Artificial Sequence: Synthetic peptide
GGSGGSGGSGGS

SEQ ID NO: 1778 - protein, 6 aa, Artificial Sequence
  Description of Artificial Sequence: Synthetic peptide
HHHHHH

SEQ ID NO: 1779 - protein, 8 aa, Artificial Sequence
  Description of Artificial Sequence: Synthetic peptide
DYKDDDDK

SEQ ID NO: 1780 - protein, 15 aa, Artificial Sequence
  Description of Artificial Sequence: Synthetic peptide
FHENFYDWFVRQVSK

SEQ ID NO: 1781 - protein, 24 aa, Artificial Sequence
  Description of Artificial Sequence: Synthetic peptide
DYKDFYDAIQLVRSARAGGTRDKK

SEQ ID NO: 1782 - protein, 18 aa, Artificial Sequence
  Description of Artificial Sequence: Synthetic peptide
FYDAIQLVRSARAGGTRD

SEQ ID NO: 1783 - protein, 27 aa, Artificial Sequence
  Description of Artificial Sequence: Synthetic peptide
DYKDVTFTSAVFHENFYDWFVRQVSKK

SEQ ID NO: 1784 - protein, 21 aa, Artificial Sequence
  Description of Artificial Sequence: Synthetic peptide
VTFTSAVFHENFYDWFVRQVS

SEQ ID NO: 1785 - protein, 4 aa, Artificial Sequence
  Description of Artificial Sequence: Synthetic peptide
GSLD

SEQ ID NO: 1786 - protein, 4 aa, Artificial Sequence
  Description of Artificial Sequence: Synthetic peptide
LGKK

SEQ ID NO: 1787 - protein, 15 aa, Artificial Sequence
  Description of Artificial Sequence: Synthetic peptide
GSLDESFYDWFERQL

SEQ ID NO: 1788 - protein, 14 aa, Artificial Sequence
  Description of Artificial Sequence: Synthetic peptide
GSLDESFYDWFERQ

SEQ ID NO: 1789 - protein, 13 aa, Artificial Sequence
  Description of Artificial Sequence: Synthetic peptide
GSLDESFYDWFER

SEQ ID NO: 1790 - protein, 11 aa, Artificial Sequence
  Description of Artificial Sequence: Synthetic peptide
ESFYDWFERQL

SEQ ID NO: 1791 - protein, 10 aa, Artificial Sequence
  Description of Artificial Sequence: Synthetic peptide
ESFYDWFERQ

SEQ ID NO: 1792 - protein, 38 aa, Artificial Sequence
  Description of Artificial Sequence: Synthetic peptide
  MOD_RES (19): Lig
  MOD_RES (38): Lig
GSLDESFYDWFERQLGKKXGSLDESFYDWFERQLGKKX

SEQ ID NO: 1793 - protein, 36 aa, Artificial Sequence
  Description of Artificial Sequence: Synthetic peptide
GSLDESFYDWFERQLGKKGSLDESFYDWFERQLGKK

SEQ ID NO: 1794 - protein, 12 aa, Artificial Sequence
  Description of Artificial Sequence: Synthetic peptide
ESFYDWFERQLG

SEQ ID NO: 1795 - protein, 26 aa, Artificial Sequence
  Description of Artificial Sequence: Synthetic peptide
ESFYDWFERQLGKESFYDWFERQLGK

SEQ ID NO: 1796 - protein, 24 aa, Artificial Sequence
  Description of Artificial Sequence: Synthetic peptide
ESFYDWFERQLGESFYDWFERQLG

SEQ ID NO: 1797 - protein, 16 aa, Artificial Sequence
  Description of Artificial Sequence: Synthetic peptide
FHENFYDWFVRQVAKK

SEQ ID NO: 1798 - protein, 16 aa, Artificial Sequence
  Description of Artificial Sequence: Synthetic peptide
FHENFYDWFVRQASKK

SEQ ID NO: 1799 - protein, 16 aa, Artificial Sequence
  Description of Artificial Sequence: Synthetic peptide
FHENFYDWFVRAVSKK

SEQ ID NO: 1800 - protein, 16 aa, Artificial Sequence
  Description of Artificial Sequence: Synthetic peptide
FHENFYDWFVAQVSKK

SEQ ID NO: 1801 - protein, 16 aa, Artificial Sequence
  Description of Artificial Sequence: Synthetic peptide
FHENFYDWFARQVSKK

SEQ ID NO: 1802 - protein, 16 aa, Artificial Sequence
  Description of Artificial Sequence: Synthetic peptide
FHEAFYDWFVRQVSKK

SEQ ID NO: 1803 - protein, 16 aa, Artificial Sequence
  Description of Artificial Sequence: Synthetic peptide
FHANFYDWFVRQVSKK

SEQ ID NO: 1804 - protein, 16 aa, Artificial Sequence
  Description of Artificial Sequence: Synthetic peptide
FAENFYDWFVRQVSKK

SEQ ID NO: 1805 - protein, 16 aa, Artificial Sequence
  Description of Artificial Sequence: Synthetic peptide
AHENFYDWFVRQVSKK

SEQ ID NO: 1806 - protein, 17 aa, Artificial Sequence
  Description of Artificial Sequence: Synthetic peptide
EFHENFYDWFVRQVSEE

SEQ ID NO: 1807 - protein, 16 aa, Artificial Sequence
  Description of Artificial Sequence: Synthetic peptide
FHENFYGWFVRQVSKK

SEQ ID NO: 1808 - protein, 13 aa, Artificial Sequence
  Description of Artificial Sequence: Synthetic peptide
HETFYSMIRSLAK

SEQ ID NO: 1809 - protein, 12 aa, Artificial Sequence
  Description of Artificial Sequence: Synthetic peptide
SDGFYNAIELLS

SEQ ID NO: 1810 - protein, 14 aa, Artificial Sequence
  Description of Artificial Sequence: Synthetic peptide
SLNFYDALQLLAKK

SEQ ID NO: 1811 - protein, 13 aa, Artificial Sequence
  Description of Artificial Sequence: Synthetic peptide
HDPFYSMMKSLLK

SEQ ID NO: 1812 - protein, 13 aa, Artificial Sequence
  Description of Artificial Sequence: Synthetic peptide
NSFYEALRMLSSK

SEQ ID NO: 1813 - protein, 13 aa, Artificial Sequence
  Description of Artificial Sequence: Synthetic peptide
HPTSKEIYAKLLK

SEQ ID NO: 1814 - protein, 13 aa, Artificial Sequence
  Description of Artificial Sequence: Synthetic peptide
HPSTNQMLMKLFK

SEQ ID NO: 1815 - protein, 14 aa, Artificial Sequence
  Description of Artificial Sequence: Synthetic peptide
HPPLSELKLFLIKK

SEQ ID NO: 1816 - protein, 12 aa, Artificial Sequence
  Description of Artificial Sequence: Synthetic peptide
WSDFYSYFQGLD

SEQ ID NO: 1817 - protein, 16 aa, Artificial Sequence
  Description of Artificial Sequence: Synthetic peptide
  SITE (16): This residue is chemically linked to the C-terminus of SEQ ID NO: 1818
FHENFYDWFVRQVSKK

SEQ ID NO: 1818 - protein, 17 aa, Artificial Sequence
  Description of Artificial Sequence: Synthetic peptide
  MOD_RES (1): Dap
XFHENFYDWFVRQVSKK

SEQ ID NO: 1819 - protein, 12 aa, Artificial Sequence
  Description of Artificial Sequence: Synthetic peptide
SSNFYQALMLLS

SEQ ID NO: 1820 - protein, 17 aa, Artificial Sequence
  Description of Artificial Sequence: Synthetic peptide
  MOD_RES (17): Lig
FHENFYDWFVRQVSKKX

SEQ ID NO: 1821 - protein, 15 aa, Artificial Sequence
  Description of Artificial Sequence: Synthetic peptide
HENFYGWFVRQVSKK

SEQ ID NO: 1822 - protein, 16 aa, Artificial Sequence
  Description of Artificial Sequence: Synthetic peptide
  SITE (16): This residue is chemically linked to the C-terminus of SEQ ID NO: 1823
FHENFYDWFVRQVSKK

SEQ ID NO: 1823 - protein, 17 aa, Artificial Sequence
  Description of Artificial Sequence: Synthetic peptide
KFHENFYDWFVRQVSKK

SEQ ID NO: 1824 - protein, 7 aa, Artificial Sequence
  Description of Artificial Sequence: Synthetic peptide
FYDWFKK

SEQ ID NO: 1825 - protein, 9 aa, Artificial Sequence
  Description of Artificial Sequence: Synthetic peptide
AFYDWFAKK

SEQ ID NO: 1826 - protein, 16 aa, Artificial Sequence
  Description of Artificial Sequence: Synthetic peptide
AAAAFYDWFAAAAAKK

SEQ ID NO: 1827 - protein, 17 aa, Artificial Sequence
  Description of Artificial Sequence: Synthetic peptide
  MOD_RES (1): Lig
  SITE (1): This residue is chemically linked to the N-terminus of SEQ ID NO: 1828
XFHENFYDWFVRQVSKK

SEQ ID NO: 1828 - protein, 17 aa, Artificial Sequence
  Description of Artificial Sequence: Synthetic peptide
  MOD_RES (1): Lig
XFHENFYDWFVRQVSKK

SEQ ID NO: 1829 - protein, 18 aa, Artificial Sequence
  Description of Artificial Sequence: Synthetic peptide
  SITE (1): This residue is chemically linked to the N-terminus of SEQ ID NO: 1830
CGFHENFYDWFVRQVSKK

SEQ ID NO: 1830 - protein, 18 aa, Artificial Sequence
  Description of Artificial Sequence: Synthetic peptide
CGFHENFYDWFVRQVSKK

SEQ ID NO: 1831 - protein, 18 aa, Artificial Sequence
  Description of Artificial Sequence: Synthetic peptide
CGFHENFYDWFVRQVSKK

SEQ ID NO: 1832 - protein, 17 aa, Artificial Sequence
  Description of Artificial Sequence: Synthetic peptide
  MOD_RES (1): Lig
  SITE (1): This residue is chemically linked to the N-terminus of SEQ ID NO: 1833
XFHENFYDWFVRQVSKK

SEQ ID NO: 1833 - protein, 17 aa, Artificial Sequence
  Description of Artificial Sequence: Synthetic peptide
  MOD_RES (1): Lig
XFHENFYDWFVRQVSKK

SEQ ID NO: 1834 - protein, 17 aa, Artificial Sequence
  Description of Artificial Sequence: Synthetic peptide
LDALDRLMRYFEERPSL

SEQ ID NO: 1835 - protein, 20 aa, Artificial Sequence
  Description of Artificial Sequence: Synthetic peptide
PLAELWAYFEHSEQGRSSAH

SEQ ID NO: 1836 - protein, 21 aa, Artificial Sequence
  Description of Artificial Sequence: Synthetic peptide
NGVERAGTGDNFYDWFVAQLH

SEQ ID NO: 1837 - protein, 21 aa, Artificial Sequence
  Description of Artificial Sequence: Synthetic peptide
EHWNTVDPFYFTLFEWLRESG

SEQ ID NO: 1838 - protein, 21 aa, Artificial Sequence
  Description of Artificial Sequence: Synthetic peptide
EHWNTVDPFYQYFSELLRESG

SEQ ID NO: 1839 - protein, 21 aa, Artificial Sequence
  Description of Artificial Sequence: Synthetic peptide
QSDSGTVHDRFYGWFRDTWAS

SEQ ID NO: 1840 - protein, 8 aa, Artificial Sequence
  Description of Artificial Sequence: Synthetic peptide
AFYDWFAK

SEQ ID NO: 1841 - protein, 7 aa, Artificial Sequence
  Description of Artificial Sequence: Synthetic peptide
AFYDWFA

SEQ ID NO: 1842 - protein, 6 aa, Artificial Sequence
  Description of Artificial Sequence: Synthetic peptide
AFYDWF

SEQ ID NO: 1843 - protein, 6 aa, Artificial Sequence
  Description of Artificial Sequence: Synthetic peptide
FYDWFA

SEQ ID NO: 1844 - protein, 5 aa, Artificial Sequence
  Description of Artificial Sequence: Synthetic peptide
FYDWF

SEQ ID NO: 1845 - protein, 9 aa, Artificial Sequence
  Description of Artificial Sequence: Synthetic peptide
AFYEWFAKK

SEQ ID NO: 1846 - protein, 9 aa, Artificial Sequence
  Description of Artificial Sequence: Synthetic peptide
AFYGWFAKK

SEQ ID NO: 1847 - protein, 9 aa, Artificial Sequence
  Description of Artificial Sequence: Synthetic peptide
AFYKWFAKK

SEQ ID NO: 1848 - protein, 13 aa, Artificial Sequence
  Description of Artificial Sequence: Synthetic peptide
  MOD_RES (13): Lig
  SITE (13): This residue is chemically linked to the C-terminus of SEQ ID NO: 1849
SDGFYNAIELLSX

SEQ ID NO: 1849 - protein, 13 aa, Artificial Sequence
  Description of Artificial Sequence: Synthetic peptide
  MOD_RES (13): Lig
SDGFYNAIELLSX

SEQ ID NO: 1850 - protein, 10 aa, Artificial Sequence
  Description of Artificial Sequence: Synthetic peptide
  MOD_RES (10): Lig
  SITE (10): This residue is chemically linked to the C-terminus of SEQ ID NO: 1851
AFYDWFAKKX

SEQ ID NO: 1851 - protein, 10 aa, Artificial Sequence
  Description of Artificial Sequence: Synthetic peptide
  MOD_RES (10): Lig
AFYDWFAKKX

SEQ ID NO: 1852 - protein, 16 aa, Artificial Sequence
  Description of Artificial Sequence: Synthetic peptide
FHENAYDWFVRQVSKK

SEQ ID NO: 1853 - protein, 16 aa, Artificial Sequence
  Description of Artificial Sequence: Synthetic peptide
FHENFADWFVRQVSKK

SEQ ID NO: 1854 - protein, 16 aa, Artificial Sequence
  Description of Artificial Sequence: Synthetic peptide
FHENFYAWFVRQVSKK

SEQ ID NO: 1855 - protein, 16 aa, Artificial Sequence
  Description of Artificial Sequence: Synthetic peptide
FHENFYDAFVRQVSKK

SEQ ID NO: 1856 - protein, 16 aa, Artificial Sequence
  Description of Artificial Sequence: Synthetic peptide
FHENFYDWAVRQVSKK

SEQ ID NO: 1857 - protein, 20 aa, Artificial Sequence
  Description of Artificial Sequence: Synthetic peptide
QLEEEWAGVQCEVYGRECPS

SEQ ID NO: 1858 - protein, 19 aa, Artificial Sequence
  Description of Artificial Sequence: Synthetic peptide
CGGFHENFYDWFVRQVSKK

SEQ ID NO: 1859 - protein, 19 aa, Artificial Sequence
  Description of Artificial Sequence: Synthetic peptide
  SITE (1): This residue is chemically linked to the N-terminus of SEQ ID NO: 1860
CGGFHENFYDWFVRQVSKK

SEQ ID NO: 1860 - protein, 19 aa, Artificial Sequence
  Description of Artificial Sequence: Synthetic peptide
CGGFHENFYDWFVRQVSKK

SEQ ID NO: 1861 - protein, 13 aa, Artificial Sequence
  Description of Artificial Sequence: Synthetic peptide
  MOD_RES (13): Lig
  SITE (13): This residue is chemically linked to the C-terminus of SEQ ID NO: 1862
SDGFYNAIELLSX

SEQ ID NO: 1862 - protein, 24 aa, Artificial Sequence
  Description of Artificial Sequence: Synthetic peptide
  MOD_RES (24): Lig
KHLCVLEELFWGASLFGYCSGKKX

SEQ ID NO: 1863 - protein, 20 aa, Artificial Sequence
  Description of Artificial Sequence: Synthetic peptide
  MOD_RES (20): Lig
  SITE (20): This residue is chemically linked to the C-terminus of SEQ ID NO: 1864
FHENFYDWFVRQVSKKGGGX

SEQ ID NO: 1864 - protein, 20 aa, Artificial Sequence
  Description of Artificial Sequence: Synthetic peptide
  MOD_RES (20): Lig
FHENFYDWFVRQVSKKGGGX

SEQ ID NO: 1865 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1866
XGGGFHENFYDWFVRQVSKK

SEQ ID NO: 1866 - protein, 20 aa, Artificial Sequence
  Description of Artificial Sequence: Synthetic peptide
  MOD_RES (1): Lig
XGGGFHENFYDWFVRQVSKK

SEQ ID NO: 1867 - protein, 17 aa, Artificial Sequence
  Description of Artificial Sequence: Synthetic peptide
  MOD_RES (17): Lig
  SITE (17): This residue is chemically linked to the C-terminus of SEQ ID NO: 1868
FHENFYDWFVRQVSKKX

SEQ ID NO: 1868 - protein, 13 aa, Artificial Sequence
  Description of Artificial Sequence: Synthetic peptide
  MOD_RES (13): Lig
SDGFYNAIELLSX

SEQ ID NO: 1869 - protein, 20 aa, Artificial Sequence
  Description of Artificial Sequence: Synthetic peptide
RVDWLQRNANFYDWFVAELG

SEQ ID NO: 1870 - protein, 19 aa, Artificial Sequence
  Description of Artificial Sequence: Synthetic peptide
VDWLQRNANFYDWFVAELG

SEQ ID NO: 1871 - protein, 18 aa, Artificial Sequence
  Description of Artificial Sequence: Synthetic peptide
DWLQRNANFYDWFVAELG

SEQ ID NO: 1872 - protein, 17 aa, Artificial Sequence
  Description of Artificial Sequence: Synthetic peptide
WLQRNANFYDWFVAELG

SEQ ID NO: 1873 - protein, 16 aa, Artificial Sequence
  Description of Artificial Sequence: Synthetic peptide
LQRNANFYDWFVAELG

SEQ ID NO: 1874 - protein, 15 aa, Artificial Sequence
  Description of Artificial Sequence: Synthetic peptide
QRNANFYDWFVAELG

SEQ ID NO: 1875 - protein, 14 aa, Artificial Sequence
  Description of Artificial Sequence: Synthetic peptide
RNANFYDWFVAELG

SEQ ID NO: 1876 - protein, 13 aa, Artificial Sequence
  Description of Artificial Sequence: Synthetic peptide
NANFYDWFVAELG

SEQ ID NO: 1877 - protein, 12 aa, Artificial Sequence
  Description of Artificial Sequence: Synthetic peptide
ANFYDWFVAELG

SEQ ID NO: 1878 - protein, 11 aa, Artificial Sequence
  Description of Artificial Sequence: Synthetic peptide
NFYDWFVAELG

SEQ ID NO: 1879 - protein, 22 aa, Artificial Sequence
  Description of Artificial Sequence: Synthetic peptide
  MOD_RES (22): Lig
GRVDWLQRNANFYDWFVAELGX

SEQ ID NO: 1880 - protein, 22 aa, Artificial Sequence
  Description of Artificial Sequence: Synthetic peptide
  MOD_RES (1): Lig
XGRVDWLQRNANFYDWFVAELG

SEQ ID NO: 1881 - protein, 15 aa, Artificial Sequence
  Description of Artificial Sequence: Synthetic peptide
  MOD_RES (15): Lig
  SITE (15): This residue is chemically linked to the C-terminus of SEQ ID NO: 1882
ACAWPTYWNCGGGGX

SEQ ID NO: 1882 - protein, 17 aa, Artificial Sequence
  Description of Artificial Sequence: Synthetic peptide
  MOD_RES (17): Lig
FHENFYDWFVRQVSKKX

SEQ ID NO: 1883 - protein, 20 aa, Artificial Sequence
  Description of Artificial Sequence: Synthetic peptide
GRVDWLQRNANFYDWFVAEL

SEQ ID NO: 1884 - protein, 19 aa, Artificial Sequence
  Description of Artificial Sequence: Synthetic peptide
GRVDWLQRNANFYDWFVAE

SEQ ID NO: 1885 - protein, 18 aa, Artificial Sequence
  Description of Artificial Sequence: Synthetic peptide
GRVDWLQRNANFYDWFVA

SEQ ID NO: 1886 - protein, 17 aa, Artificial Sequence
  Description of Artificial Sequence: Synthetic peptide
GRVDWLQRNANFYDWFV

SEQ ID NO: 1887 - protein, 13 aa, Artificial Sequence
  Description of Artificial Sequence: Synthetic peptide
  MOD_RES (13): Lig
  SITE (13): This residue is chemically linked to the C-terminus of SEQ ID NO: 1888
SDGFYNAIELLSX

SEQ ID NO: 1888 - protein, 13 aa, Artificial Sequence
  Description of Artificial Sequence: Synthetic peptide
  MOD_RES (13): Lig
SDGFYNAIELLSX

SEQ ID NO: 1889 - protein, 22 aa, Artificial Sequence
  Description of Artificial Sequence: Synthetic peptide
  MOD_RES (22): Lig
  SITE (22): This residue is chemically linked to the C-terminus of SEQ ID NO: 1890
GRVDWLQRNANFYDWFVAELGX

SEQ ID NO: 1890 - protein, 22 aa, Artificial Sequence
  Description of Artificial Sequence: Synthetic peptide
  MOD_RES (22): Lig
GRVDWLQRNANFYDWFVAELGX

SEQ ID NO: 1891 - protein, 16 aa, Artificial Sequence
  Description of Artificial Sequence: Synthetic peptide
  MOD_RES (16): Lig
  SITE (16): This residue is chemically linked to the C-terminus of SEQ ID NO: 1892
SDGFYNAIELLSGGGX

SEQ ID NO: 1892 - protein, 16 aa, Artificial Sequence
  Description of Artificial Sequence: Synthetic peptide
  MOD_RES (16): Lig
SDGFYNAIELLSGGGX

SEQ ID NO: 1893 - protein, 15 aa, Artificial Sequence
  Description of Artificial Sequence: Synthetic peptide
  MOD_RES (1): Acy
  MOD_RES (11): Tic
XCLEEWGASLXQCSG

SEQ ID NO: 1894 - protein, 17 aa, Artificial Sequence
  Description of Artificial Sequence: Synthetic peptide
RWPNFYGYFESLLTHFS

SEQ ID NO: 1895 - protein, 17 aa, Artificial Sequence
  Description of Artificial Sequence: Synthetic peptide
EGWDFYSYFSGLLASVT

SEQ ID NO: 1896 - protein, 17 aa, Artificial Sequence
  Description of Artificial Sequence: Synthetic peptide
LDRQFYRYFQDLLVGFM

SEQ ID NO: 1897 - protein, 17 aa, Artificial Sequence
  Description of Artificial Sequence: Synthetic peptide
WGRSFYRYFETLLAQGI

SEQ ID NO: 1898 - protein, 20 aa, Artificial Sequence
  Description of Artificial Sequence: Synthetic peptide
PLCFLQELFGGASLGGYCSG

SEQ ID NO: 1899 - protein, 20 aa, Artificial Sequence
  Description of Artificial Sequence: Synthetic peptide
WLEQERAWIWCEIQGSGCRA

SEQ ID NO: 1900 - protein, 21 aa, Artificial Sequence
  Description of Artificial Sequence: Synthetic peptide
IQGWEPFYGWFDDVVAQMFEE

SEQ ID NO: 1901 - protein, 21 aa, Artificial Sequence
  Description of Artificial Sequence: Synthetic peptide
TGHRLGLDEQFYWWFRDALSG

SEQ ID NO: 1902 - protein, 15 aa, Artificial Sequence
  Description of Artificial Sequence: Synthetic peptide
  MOD_RES (1): Abu
  MOD_RES (11): Tic
XCLEEWGASLXQCSG

SEQ ID NO: 1903 - protein, 11 aa, Artificial Sequence
  Description of Artificial Sequence: Synthetic peptide
  MOD_RES (3): Hyp
RDXFYDWFDDI

SEQ ID NO: 1904 - protein, 30 aa, Artificial Sequence
  Description of Artificial Sequence: Synthetic peptide
  MOD_RES (17)..(18): Lig
FHENFYDWFVRQVSKKXXSDGFYNAIELLS

SEQ ID NO: 1905 - protein, 16 aa, Artificial Sequence
  Description of Artificial Sequence: Synthetic peptide
GFREGQRWYWFVAQVT

SEQ ID NO: 1906 - protein, 20 aa, Artificial Sequence
  Description of Artificial Sequence: Synthetic peptide
DLRVLCELFGGAYVLGYCSE

SEQ ID NO: 1907 - protein, 20 aa, Artificial Sequence
  Description of Artificial Sequence: Synthetic peptide
HLSVGEELSWWVALLGQWAR

SEQ ID NO: 1908 - protein, 20 aa, Artificial Sequence
  Description of Artificial Sequence: Synthetic peptide
APVSTEELRWGALLFGQWAG

SEQ ID NO: 1909 - protein, 20 aa, Artificial Sequence
  Description of Artificial Sequence: Synthetic peptide
ALEEEWAWVQVRSIRSGLPL

SEQ ID NO: 1910 - protein, 20 aa, Artificial Sequence
  Description of Artificial Sequence: Synthetic peptide
WLEHEWAQIQCELYGRGCTY

SEQ ID NO: 1911 - protein, 17 aa, Artificial Sequence
  Description of Artificial Sequence: Synthetic peptide
QAPSNFYDWFVREWDEE

SEQ ID NO: 1912 - protein, 17 aa, Artificial Sequence
  Description of Artificial Sequence: Synthetic peptide
QSFYDYIEELLGGEWKK

SEQ ID NO: 1913 - protein, 17 aa, Artificial Sequence
  Description of Artificial Sequence: Synthetic peptide
DPFYQGLWEWLRESGEE

SEQ ID NO: 1914 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1915
XGGGFHENFYDWFVRQVSKK

SEQ ID NO: 1915 - protein, 20 aa, Artificial Sequence
  Description of Artificial Sequence: Synthetic peptide
  MOD_RES (1): Lig
XGGGFHENFYDWFVRQVSKK

SEQ ID NO: 1916 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1917
XGGGFHENFYDWFVRQVSKK

SEQ ID NO: 1917 - protein, 20 aa, Artificial Sequence
  Description of Artificial Sequence: Synthetic peptide
  MOD_RES (1): Lig
XGGGFHENFYDWFVRQVSKK

SEQ ID NO: 1918 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1919
XGGGFHENFYDWFVRQVSKK

SEQ ID NO: 1919 - protein, 20 aa, Artificial Sequence
  Description of Artificial Sequence: Synthetic peptide
  MOD_RES (1): Lig
XGGGFHENFYDWFVRQVSKK

SEQ ID NO: 1920 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1921
XGGGFHENFYDWFVRQVSKK

SEQ ID NO: 1921 - protein, 20 aa, Artificial Sequence
  Description of Artificial Sequence: Synthetic peptide
  MOD_RES (1): Lig
XGGGFHENFYDWFVRQVSKK

SEQ ID NO: 1922 - protein, 18 aa, Artificial Sequence
  Description of Artificial Sequence: Synthetic peptide
  MOD_RES (18): Lig
DWLQRNANFYDWFVAELX

SEQ ID NO: 1923 - protein, 18 aa, Artificial Sequence
  Description of Artificial Sequence: Synthetic peptide
  MOD_RES (1): Lig
XDWLQRNANFYDWFVAEL

SEQ ID NO: 1924 - protein, 17 aa, Artificial Sequence
  Description of Artificial Sequence: Synthetic peptide
  MOD_RES (17): Lig
  SITE (17): This residue is chemically linked to the C-terminus of SEQ ID NO: 1925
DWLQRNANFYDWFVAEX

SEQ ID NO: 1925 - protein, 17 aa, Artificial Sequence
  Description of Artificial Sequence: Synthetic peptide
  MOD_RES (17): Lig
DWLQRNANFYDWFVAEX

SEQ ID NO: 1926 - protein, 18 aa, Artificial Sequence
  Description of Artificial Sequence: Synthetic peptide
  MOD_RES (1): Lig
  SITE (1): This residue is chemically linked to the N-terminus of SEQ ID NO: 1927
XDWLQRNANFYDWFVAEL

SEQ ID NO: 1927 - protein, 18 aa, Artificial Sequence
  Description of Artificial Sequence: Synthetic peptide
  MOD_RES (1): Lig
XDWLQRNANFYDWFVAEL

SEQ ID NO: 1928 - protein, 13 aa, Artificial Sequence
  Description of Artificial Sequence: Synthetic peptide
  MOD_RES (8): Acy
SDGFYNAXELLSG

SEQ ID NO: 1929 - protein, 14 aa, Artificial Sequence
  Description of Artificial Sequence: Synthetic peptide
  MOD_RES (8): Acy
  MOD_RES (13): Aib
SGPFYEEXELLWXG

SEQ ID NO: 1930 - protein, 14 aa, Artificial Sequence
  Description of Artificial Sequence: Synthetic peptide
  MOD_RES (8): Acy
  MOD_RES (10): Aib
  MOD_RES (13): Aib
GGSFYDDXEXLWXG

SEQ ID NO: 1931 - protein, 14 aa, Artificial Sequence
  Description of Artificial Sequence: Synthetic peptide
  MOD_RES (2): Aib
  MOD_RES (8): Acy
  MOD_RES (11): Cha
  MOD_RES (13): Aib
NXPFYDEXDEXWXG

SEQ ID NO: 1932 - protein, 21 aa, Artificial Sequence
  Description of Artificial Sequence: Synthetic peptide
  MOD_RES (20): Acy
GRVDWLQRNANFYDWFVAEXG

SEQ ID NO: 1933 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1934
XGGGFHENFYDWFVRQVSKK

SEQ ID NO: 1934 - protein, 20 aa, Artificial Sequence
  Description of Artificial Sequence: Synthetic peptide
  MOD_RES (1): Lig
XGGGFHENFYDWFVRQVSKK

SEQ ID NO: 1935 - protein, 13 aa, Artificial Sequence
  Description of Artificial Sequence: Synthetic peptide
  MOD_RES (13): Lig
  SITE (13): This residue is chemically linked to the C-terminus of SEQ ID NO: 1935
SDGFYNAIELLSX

SEQ ID NO: 1936 - protein, 13 aa, Artificial Sequence
  Description of Artificial Sequence: Synthetic peptide
  MOD_RES (13): Lig
SDGFYNAIELLSX

SEQ ID NO: 1937 - protein, 8 aa, Artificial Sequence
  Description of Artificial Sequence: Synthetic peptide
WFYDWFWE

SEQ ID NO: 1938 - protein, 8 aa, Artificial Sequence
  Description of Artificial Sequence: Synthetic peptide
WQGYAWLS

SEQ ID NO: 1939 - protein, 8 aa, Artificial Sequence
  Description of Artificial Sequence: Synthetic peptide
WPGYAWLS

SEQ ID NO: 1940 - protein, 15 aa, Artificial Sequence
  Description of Artificial Sequence: Synthetic peptide
  MOD_RES (2): Aic
  MOD_RES (4): Aib
DXDXEFYDWFDEIPQ

SEQ ID NO: 1941 - protein, 15 aa, Artificial Sequence
  Description of Artificial Sequence: Synthetic peptide
KNNKEFYEWFDEIGQ

SEQ ID NO: 1942 - protein, 15 aa, Artificial Sequence
  Description of Artificial Sequence: Synthetic peptide
  MOD_RES (5): Hyp
YERDXFYDWFDEIGQ

SEQ ID NO: 1943 - protein, 15 aa, Artificial Sequence
  Description of Artificial Sequence: Synthetic peptide
  MOD_RES (5): Hyp
  MOD_RES (14): Hyp
EWRDXFYDWFDEIXE

SEQ ID NO: 1944 - protein, 19 aa, Artificial Sequence
  Description of Artificial Sequence: Synthetic peptide
  MOD_RES (1): Lig
  SITE (1): This residue is chemically linked to the N-terminus of SEQ ID NO: 1945
XGSLDESFYDWFERQLGKK

SEQ ID NO: 1945 - protein, 19 aa, Artificial Sequence
  Description of Artificial Sequence: Synthetic peptide
  MOD_RES (1): Lig
XGSLDESFYDWFERQLGKK

SEQ ID NO: 1946 - protein, 27 aa, Artificial Sequence
  Description of Artificial Sequence: Synthetic peptide
TFYSCLASLLTGTPQPNRGPWERCRKK

SEQ ID NO: 1947 - protein, 17 aa, Artificial Sequence
  Description of Artificial Sequence: Synthetic peptide
  MOD_RES (1): Lig
  SITE (1): This residue is chemically linked to the N-terminus of SEQ ID NO: 1948
XFHENFYDWFVRQVSKK

SEQ ID NO: 1948 - protein, 17 aa, Artificial Sequence
  Description of Artificial Sequence: Synthetic peptide
  MOD_RES (1): Lig
XFHENFYDWFVRQVSKK

SEQ ID NO: 1949 - protein, 23 aa, Artificial Sequence
  Description of Artificial Sequence: Synthetic peptide
KHLCVLEELFWGASLFGYCSGKK

SEQ ID NO: 1950 - protein, 19 aa, Artificial Sequence
  Description of Artificial Sequence: Synthetic peptide
  MOD_RES (19): Lig
  SITE (19): This residue is chemically linked to the C-terminus of SEQ ID NO: 1951
GSLDESFYDWFERQLGKKX

SEQ ID NO: 1951 - protein, 19 aa, Artificial Sequence
  Description of Artificial Sequence: Synthetic peptide
  MOD_RES (19): Lig
GSLDESFYDWFERQLGKKX

SEQ ID NO: 1952 - protein, 19 aa, Artificial Sequence
  Description of Artificial Sequence: Synthetic peptide
  MOD_RES (1): Lig
  SITE (1): This residue is chemically linked to the N-terminus of SEQ ID NO: 1953
XGSLDESFYDWFERQLGKK

SEQ ID NO: 1953 - protein, 19 aa, Artificial Sequence
  Description of Artificial Sequence: Synthetic peptide
  MOD_RES (1): Lig
XGSLDESFYDWFERQLGKK

SEQ ID NO: 1954 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1955
XGGGFHENFYDWFVRQVSKK

SEQ ID NO: 1955 - protein, 20 aa, Artificial Sequence
  Description of Artificial Sequence: Synthetic peptide
  MOD_RES (1): Lig
XGGGFHENFYDWFVRQVSKK

SEQ ID NO: 1956 - protein, 19 aa, Artificial Sequence
  Description of Artificial Sequence: Synthetic peptide
  MOD_RES (19): Lig
  SITE (19): This residue is chemically linked to the C-terminus of SEQ ID NO: 1957
GSLDESFYDWFERQLGKKX

SEQ ID NO: 1957 - protein, 19 aa, Artificial Sequence
  Description of Artificial Sequence: Synthetic peptide
  MOD_RES (19): Lig
GSLDESFYDWFERQLGKKX

SEQ ID NO: 1958 - protein, 19 aa, Artificial Sequence
  Description of Artificial Sequence: Synthetic peptide
  MOD_RES (1): Lig
  SITE (1): This residue is chemically linked to the N-terminus of SEQ ID NO: 1959
XGSLDESFYDWFERQLGKK

SEQ ID NO: 1959 - protein, 19 aa, Artificial Sequence
  Description of Artificial Sequence: Synthetic peptide
  MOD_RES (1): Lig
XGSLDESFYDWFERQLGKK

SEQ ID NO: 1960 - protein, 19 aa, Artificial Sequence
  Description of Artificial Sequence: Synthetic peptide
  MOD_RES (19): Lig
  SITE (19): This residue is chemically linked to the C-terminus of SEQ ID NO: 1961
GSLDESFYDWFERQLGKKX

SEQ ID NO: 1961 - protein, 19 aa, Artificial Sequence
  Description of Artificial Sequence: Synthetic peptide
  MOD_RES (19): Lig
GSLDESFYDWFERQLGKKX

SEQ ID NO: 1962 - protein, 21 aa, Artificial Sequence
  Description of Artificial Sequence: Synthetic peptide
DLWFNAKEDMNFYDWFVWQLR

SEQ ID NO: 1963 - protein, 22 aa, Artificial Sequence
  Description of Artificial Sequence: Synthetic peptide
EHWNTVDPFYHWISELLRESGA

SEQ ID NO: 1964 - protein, 22 aa, Artificial Sequence
  Description of Artificial Sequence: Synthetic peptide
EHWNTVDPFYQYFAELLRESGA

SEQ ID NO: 1965 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1966
XGGGFHENFYDWFVRQVSKK

SEQ ID NO: 1966 - protein, 20 aa, Artificial Sequence
  Description of Artificial Sequence: Synthetic peptide
  MOD_RES (1): Lig
XGGGFHENFYDWFVRQVSKK

SEQ ID NO: 1967 - protein, 19 aa, Artificial Sequence
  Description of Artificial Sequence: Synthetic peptide
  MOD_RES (19): Lig
  SITE (19): This residue is chemically linked to the C-terminus of SEQ ID NO: 1968
GSLDESFYDWFERQLGKKX

SEQ ID NO: 1968 - protein, 19 aa, Artificial Sequence
  Description of Artificial Sequence: Synthetic peptide
  MOD_RES (19): Lig
GSLDESFYDWFERQLGKKX

SEQ ID NO: 1969 - protein, 19 aa, Artificial Sequence
  Description of Artificial Sequence: Synthetic peptide
  MOD_RES (1): Lig
  SITE (1): This residue is chemically linked to the N-terminus of SEQ ID NO: 1970
XGSLDESFYDWFERQLGKK

SEQ ID NO: 1970 - protein, 19 aa, Artificial Sequence
  Description of Artificial Sequence: Synthetic peptide
  MOD_RES (1): Lig
XGSLDESFYDWFERQLGKK

SEQ ID NO: 1971 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1972
XGGGFHENFYDWFVRQVSKK

SEQ ID NO: 1972 - protein, 20 aa, Artificial Sequence
  Description of Artificial Sequence: Synthetic peptide
  MOD_RES (1): Lig
XGGGFHENFYDWFVRQVSKK

SEQ ID NO: 1973 - protein, 19 aa, Artificial Sequence
  Description of Artificial Sequence: Synthetic peptide
  MOD_RES (19): Lig
  SITE (19): This residue is chemically linked to the C-terminus of SEQ ID NO: 1974
GSLDESFYDWFERQLGKKX

SEQ ID NO: 1974 - protein, 19 aa, Artificial Sequence
  Description of Artificial Sequence: Synthetic peptide
  MOD_RES (19): Lig
GSLDESFYDWFERQLGKKX

SEQ ID NO: 1975 - protein, 19 aa, Artificial Sequence
  Description of Artificial Sequence: Synthetic peptide
  MOD_RES (1): Lig
  SITE (1): This residue is chemically linked to the N-terminus of SEQ ID NO: 1976
XGSLDESFYDWFERQLGKK

SEQ ID NO: 1976 - protein, 19 aa, Artificial Sequence
  Description of Artificial Sequence: Synthetic peptide
  MOD_RES (1): Lig
XGSLDESFYDWFERQLGKK

SEQ ID NO: 1977 - protein, 18 aa, Artificial Sequence
  Description of Artificial Sequence: Synthetic peptide
  MOD_RES (1): Lig
  SITE (1): This residue is chemically linked to the N-terminus of SEQ ID NO: 1978
XDWLQRNANFYDWFVAEL

SEQ ID NO: 1978 - protein, 18 aa, Artificial Sequence
  Description of Artificial Sequence: Synthetic peptide
  MOD_RES (1): Lig
XDWLQRNANFYDWFVAEL

SEQ ID NO: 1979 - protein, 18 aa, Artificial Sequence
  Description of Artificial Sequence: Synthetic peptide
  MOD_RES (1): Lig
  SITE (1): This residue is chemically linked to the N-terminus of SEQ ID NO: 1980
XDWLQRNANFYDWFVAEL

SEQ ID NO: 1980 - protein, 18 aa, Artificial Sequence
  Description of Artificial Sequence: Synthetic peptide
  MOD_RES (1): Lig
XDWLQRNANFYDWFVAEL

SEQ ID NO: 1981 - protein, 19 aa, Artificial Sequence
  Description of Artificial Sequence: Synthetic peptide
  MOD_RES (19): Lig
  SITE (19): This residue is chemically linked to the C-terminus of SEQ ID NO: 1982
GSLDESFYDWFERQLGKKX

SEQ ID NO: 1982 - protein, 19 aa, Artificial Sequence
  Description of Artificial Sequence: Synthetic peptide
  MOD_RES (19): Lig
GSLDESFYDWFERQLGKKX

SEQ ID NO: 1983 - protein, 19 aa, Artificial Sequence
  Description of Artificial Sequence: Synthetic peptide
  MOD_RES (1): Lig
  SITE (1): This residue is chemically linked to the N-terminus of SEQ ID NO: 1984
XGSLDESFYDWFERQLGKK

SEQ ID NO: 1984 - protein, 19 aa, Artificial Sequence
  Description of Artificial Sequence: Synthetic peptide
  MOD_RES (1): Lig
XGSLDESFYDWFERQLGKK

SEQ ID NO: 1985 - protein, 20 aa, Artificial Sequence
  Description of Artificial Sequence: Synthetic peptide
  MOD_RES (1): Lig
  SITE (1): This residue is chemically linked to the N-terminus of SEQ ID NO: 1986
XGGGFHENFYDWFVRQVSKK

SEQ ID NO: 1986 - protein, 20 aa, Artificial Sequence
  Description of Artificial Sequence: Synthetic peptide
  MOD_RES (1): Lig
XGGGFHENFYDWFVRQVSKK

SEQ ID NO: 1987 - protein, 21 aa, Artificial Sequence
  Description of Artificial Sequence: Synthetic peptide
RMYFSTGAPQNFYDWFVQEWD

SEQ ID NO: 1988 - protein, 17 aa, Artificial Sequence
  Description of Artificial Sequence: Synthetic peptide
PLRESRNFYDWFVQQLE

SEQ ID NO: 1989 - protein, 19 aa, Artificial Sequence
  Description of Artificial Sequence: Synthetic peptide
RGTRSDPFYHKLSELLQGH

SEQ ID NO: 1990 - protein, 19 aa, Artificial Sequence
  Description of Artificial Sequence: Synthetic peptide
SGSLDESFYDWFERQLGKK

SEQ ID NO: 1991 - protein, 20 aa, Artificial Sequence
  Description of Artificial Sequence: Synthetic peptide
GSLDESFYDWFERQLGKKKS

SEQ ID NO: 1992 - protein, 19 aa, Artificial Sequence
  Description of Artificial Sequence: Synthetic peptide
  MOD_RES (1): Ald
  SITE (1): This residue is chemically linked to the N-terminus of SEQ ID NO: 1993
XGSLDESFYDWFERQLGKK

SEQ ID NO: 1993 - protein, 19 aa, Artificial Sequence
  Description of Artificial Sequence: Synthetic peptide
  MOD_RES (1): Ald
XGSLDESFYDWFERQLGKK

SEQ ID NO: 1994 - protein, 39 aa, Artificial Sequence
  Description of Artificial Sequence: Synthetic peptide
  MOD_RES (20)..(21): Ald
GSLDESFYDWFERQLGKKKXXGSLDESFYDWFERQLGKK

SEQ ID NO: 1995 - protein, 19 aa, Artificial Sequence
  Description of Artificial Sequence: Synthetic peptide
  MOD_RES (1): Ald
  SITE (1): This residue is chemically linked to the N-terminus of SEQ ID NO: 1996
XGSLDESFYDWFERQLGKK

SEQ ID NO: 1996 - protein, 19 aa, Artificial Sequence
  Description of Artificial Sequence: Synthetic peptide
  MOD_RES (1): Ald
XGSLDESFYDWFERQLGKK

SEQ ID NO: 1997 - protein, 20 aa, Artificial Sequence
  Description of Artificial Sequence: Synthetic peptide
  MOD_RES (20): Ald
  SITE (20): This residue is chemically linked to the C-terminus of SEQ ID NO: 1998
GSLDESFYDWFERQLGKKKX

SEQ ID NO: 1998 - protein, 20 aa, Artificial Sequence
  Description of Artificial Sequence: Synthetic peptide
  MOD_RES (20): Ald
GSLDESFYDWFERQLGKKKX

SEQ ID NO: 1999 - protein, 20 aa, Artificial Sequence
  Description of Artificial Sequence: Synthetic peptide
  MOD_RES (20): Ald
  SITE (20): This residue is chemically linked to the C-terminus of SEQ ID NO: 2000
GSLDESFYDWFERQLGKKKX

SEQ ID NO: 2000 - protein, 20 aa, Artificial Sequence
  Description of Artificial Sequence: Synthetic peptide
  MOD_RES (20): Ald
GSLDESFYDWFERQLGKKKX

SEQ ID NO: 2001 - protein, 20 aa, Artificial Sequence
  Description of Artificial Sequence: Synthetic peptide
  MOD_RES (20): Lig
  SITE (20): This residue is chemically linked to the C-terminus of SEQ ID NO: 2002
EEDWLQRNANFYDWFVAELX

SEQ ID NO: 2002 - protein, 20 aa, Artificial Sequence
  Description of Artificial Sequence: Synthetic peptide
  MOD_RES (20): Lig
EEDWLQRNANFYDWFVAELX

SEQ ID NO: 2003 - protein, 20 aa, Artificial Sequence
  Description of Artificial Sequence: Synthetic peptide
  MOD_RES (20): Lig
  SITE (20): This residue is chemically linked to the C-terminus of SEQ ID NO: 2004
EEDWLQRNANFYDWFVAELX

SEQ ID NO: 2004 - protein, 20 aa, Artificial Sequence
  Description of Artificial Sequence: Synthetic peptide
  MOD_RES (20): Lig
EEDWLQRNANFYDWFVAELX

SEQ ID NO: 2005 - protein, 15 aa, Artificial Sequence
  Description of Artificial Sequence: Synthetic peptide
SLDESFYDWFERQLG

SEQ ID NO: 2006 - protein, 14 aa, Artificial Sequence
  Description of Artificial Sequence: Synthetic peptide
LDESFYDWFERQLG

SEQ ID NO: 2007 - protein, 13 aa, Artificial Sequence
  Description of Artificial Sequence: Synthetic peptide
DESFYDWFERQLG

SEQ ID NO: 2008 - protein, 11 aa, Artificial Sequence
  Description of Artificial Sequence: Synthetic peptide
SFYDWFERQLG

SEQ ID NO: 2009 - protein, 10 aa, Artificial Sequence
  Description of Artificial Sequence: Synthetic peptide
FYDWFERQLG

SEQ ID NO: 2010 - protein, 12 aa, Artificial Sequence
  Description of Artificial Sequence: Synthetic peptide
GSLDESFYDWFE

SEQ ID NO: 2011 - protein, 11 aa, Artificial Sequence
  Description of Artificial Sequence: Synthetic peptide
GSLDESFYDWF

SEQ ID NO: 2012 - protein, 9 aa, Artificial Sequence
  Description of Artificial Sequence: Synthetic peptide
ESFYDWFER

SEQ ID NO: 2013 - protein, 8 aa, Artificial Sequence
  Description of Artificial Sequence: Synthetic peptide
ESFYDWFE

SEQ ID NO: 2014 - protein, 7 aa, Artificial Sequence
  Description of Artificial Sequence: Synthetic peptide
ESFYDWF

SEQ ID NO: 2015 - protein, 14 aa, Artificial Sequence
  Description of Artificial Sequence: Synthetic peptide
  MOD_RES (14): Lig
  SITE (14): This residue is chemically linked to the C-terminus of SEQ ID NO: 2016
ESFYDWFERQLGKX

SEQ ID NO: 2016 - protein, 14 aa, Artificial Sequence
  Description of Artificial Sequence: Synthetic peptide
  MOD_RES (14): Lig
ESFYDWFERQLGKX

SEQ ID NO: 2017 - protein, 14 aa, Artificial Sequence
  Description of Artificial Sequence: Synthetic peptide
  MOD_RES (14): Lig
  SITE (14): This residue is chemically linked to the C-terminus of SEQ ID NO: 2018
ESFYDWFERQLGKX

SEQ ID NO: 2018 - protein, 14 aa, Artificial Sequence
  Description of Artificial Sequence: Synthetic peptide
  MOD_RES (14): Lig
ESFYDWFERQLGKX

SEQ ID NO: 2019 - protein, 13 aa, Artificial Sequence
  Description of Artificial Sequence: Synthetic peptide
  MOD_RES (1): Lig
  SITE (1): This residue is chemically linked to the N-terminus of SEQ ID NO: 2020
XESFYDWFERQLG

SEQ ID NO: 2020 - protein, 13 aa, Artificial Sequence
  Description of Artificial Sequence: Synthetic peptide
  MOD_RES (1): Lig
XESFYDWFERQLG

SEQ ID NO: 2021 - protein, 13 aa, Artificial Sequence
  Description of Artificial Sequence: Synthetic peptide
  MOD_RES (1): Lig
  SITE (1): This residue is chemically linked to the N-terminus of SEQ ID NO: 2022
XESFYDWFERQLG

SEQ ID NO: 2022 - protein, 13 aa, Artificial Sequence
  Description of Artificial Sequence: Synthetic peptide
  MOD_RES (1): Lig
XESFYDWFERQLG

SEQ ID NO: 2023 - protein, 14 aa, Artificial Sequence
  Description of Artificial Sequence: Synthetic peptide
  MOD_RES (14): Ald
  SITE (14): This residue is chemically linked to the C-terminus of SEQ ID NO: 2024
ESFYDWFERQLGKX

SEQ ID NO: 2024 - protein, 14 aa, Artificial Sequence
  Description of Artificial Sequence: Synthetic peptide
  MOD_RES (14): Ald
ESFYDWFERQLGKX

SEQ ID NO: 2025 - protein, 24 aa, Artificial Sequence
  Description of Artificial Sequence: Synthetic peptide
  MOD_RES (1): Lig
  SITE (1): This residue is chemically linked to the N-terminus of SEQ ID NO: 2026
XEWLDQEWAWVQCEVYGRGCPSEE

SEQ ID NO: 2026 - protein, 24 aa, Artificial Sequence
  Description of Artificial Sequence: Synthetic peptide
  MOD_RES (1): Lig
XEWLDQEWAWVQCEVYGRGCPSEE

SEQ ID NO: 2027 - protein, 13 aa, Artificial Sequence
  Description of Artificial Sequence: Synthetic peptide
  MOD_RES (1): Ald
  SITE (1): This residue is chemically linked to the N-terminus of SEQ ID NO: 2028
XESFYDWFERQLG

SEQ ID NO: 2028 - protein, 13 aa, Artificial Sequence
  Description of Artificial Sequence: Synthetic peptide
  MOD_RES (1): Ald
XESFYDWFERQLG

SEQ ID NO: 2029 - protein, 13 aa, Artificial Sequence
  Description of Artificial Sequence: Synthetic peptide
  SITE (13): This residue is chemically linked to the C-terminus of SEQ ID NO: 2030
ESFYDWFERQLGK

SEQ ID NO: 2030 - protein, 11 aa, Artificial Sequence
  Description of Artificial Sequence: Synthetic peptide
ACAWPTYWNCG

SEQ ID NO: 2031 - protein, 43 aa, Artificial Sequence
  Description of Artificial Sequence: Synthetic peptide
  MOD_RES (19)..(20): Lig
GSLDESFYDWFERQLGKKXXEWLDQEWAWVQCEVYGRGCPSEE

SEQ ID NO: 2032 - protein, 43 aa, Artificial Sequence
  Description of Artificial Sequence: Synthetic peptide
  MOD_RES (24)..(25): Lig
EWLDQEWAWVQCEVYGRGCPSEEXXGSLDESFYDWFERQLGKK

SEQ ID NO: 2033 - protein, 16 aa, Artificial Sequence
  Description of Artificial Sequence: Synthetic peptide
  SITE (16): This residue is chemically linked to the C-terminus of SEQ ID NO: 2034
ESFYDWFERQLGGGGK

SEQ ID NO: 2034 - protein, 10 aa, Artificial Sequence
  Description of Artificial Sequence: Synthetic peptide
CEVYGRGCPS

SEQ ID NO: 2035 - protein, 16 aa, Artificial Sequence
  Description of Artificial Sequence: Synthetic peptide
  SITE (16): This residue is chemically linked to the C-terminus of SEQ ID NO: 2036
ESFYDWFERQLGGGGK

SEQ ID NO: 2036 - protein, 10 aa, Artificial Sequence
  Description of Artificial Sequence: Synthetic peptide
WLDQEWAWVQ

SEQ ID NO: 2037 - protein, 16 aa, Artificial Sequence
  Description of Artificial Sequence: Synthetic peptide
  SITE (16): This residue is chemically linked to the C-terminus of SEQ ID NO: 2038
ESFYDWFERQLGGGGK

SEQ ID NO: 2038 - protein, 20 aa, Artificial Sequence
  Description of Artificial Sequence: Synthetic peptide
WLDQEWAWVQCEVYGRGCPS

SEQ ID NO: 2039 - protein, 16 aa, Artificial Sequence
  Description of Artificial Sequence: Synthetic peptide
  SITE (16): This residue is chemically linked to the C-terminus of SEQ ID NO: 2040
ESFYDWFERQLGGGGK

SEQ ID NO: 2040 - protein, 19 aa, Artificial Sequence
  Description of Artificial Sequence: Synthetic peptide
LDQEWAWVQCEVYGRGCPS

SEQ ID NO: 2041 - protein, 16 aa, Artificial Sequence
  Description of Artificial Sequence: Synthetic peptide
  SITE (16): This residue is chemically linked to the C-terminus of SEQ ID NO: 2042
ESFYDWFERQLGGGGK

SEQ ID NO: 2042 - protein, 18 aa, Artificial Sequence
  Description of Artificial Sequence: Synthetic peptide
DQEWAWVQCEVYGRGCPS

SEQ ID NO: 2043 - protein, 16 aa, Artificial Sequence
  Description of Artificial Sequence: Synthetic peptide
  SITE (16): This residue is chemically linked to the C-terminus of SEQ ID NO: 2044
ESFYDWFERQLGGGGK

SEQ ID NO: 2044 - protein, 17 aa, Artificial Sequence
  Description of Artificial Sequence: Synthetic peptide
QEWAWVQCEVYGRGCPS

SEQ ID NO: 2045 - protein, 16 aa, Artificial Sequence
  Description of Artificial Sequence: Synthetic peptide
  SITE (16): This residue is chemically linked to the C-terminus of SEQ ID NO: 2046
ESFYDWFERQLGGGGK

SEQ ID NO: 2046 - protein, 16 aa, Artificial Sequence
  Description of Artificial Sequence: Synthetic peptide
EWAWVQCEVYGRGCPS

SEQ ID NO: 2047 - protein, 16 aa, Artificial Sequence
  Description of Artificial Sequence: Synthetic peptide
  SITE (16): This residue is chemically linked to the C-terminus of SEQ ID NO: 2048
ESFYDWFERQLGGGGK

SEQ ID NO: 2048 - protein, 15 aa, Artificial Sequence
  Description of Artificial Sequence: Synthetic peptide
WAWVQCEVYGRGCPS

SEQ ID NO: 2049 - protein, 16 aa, Artificial Sequence
  Description of Artificial Sequence: Synthetic peptide
  SITE (16): This residue is chemically linked to the C-terminus of SEQ ID NO: 2050
ESFYDWFERQLGGGGK

SEQ ID NO: 2050 - protein, 14 aa, Artificial Sequence
  Description of Artificial Sequence: Synthetic peptide
AWVQCEVYGRGCPS

SEQ ID NO: 2051 - protein, 16 aa, Artificial Sequence
  Description of Artificial Sequence: Synthetic peptide
  SITE (16): This residue is chemically linked to the C-terminus of SEQ ID NO: 2052
ESFYDWFERQLGGGGK

SEQ ID NO: 2052 - protein, 13 aa, Artificial Sequence
  Description of Artificial Sequence: Synthetic peptide
WVQCEVYGRGCPS

SEQ ID NO: 2053 - protein, 16 aa, Artificial Sequence
  Description of Artificial Sequence: Synthetic peptide
  SITE (16): This residue is chemically linked to the C-terminus of SEQ ID NO: 2054
ESFYDWFERQLGGGGK

SEQ ID NO: 2054 - protein, 12 aa, Artificial Sequence
  Description of Artificial Sequence: Synthetic peptide
VQCEVYGRGCPS

SEQ ID NO: 2055 - protein, 16 aa, Artificial Sequence
  Description of Artificial Sequence: Synthetic peptide
  SITE (16): This residue is chemically linked to the C-terminus of SEQ ID NO: 2056
ESFYDWFERQLGGGGK

SEQ ID NO: 2056 - protein, 11 aa, Artificial Sequence
  Description of Artificial Sequence: Synthetic peptide
QCEVYGRGCPS

SEQ ID NO: 2057 - protein, 45 aa, Artificial Sequence
  Description of Artificial Sequence: Synthetic peptide
  MOD_RES (20)..(21): Ald
GSLDESFYDWFERQLGKKKXXKEWLDQEWAWVQCEVYGRGCPSEE

SEQ ID NO: 2058 - protein, 20 aa, Artificial Sequence
  Description of Artificial Sequence: Synthetic peptide
  MOD_RES (20): Ald
  SITE (20): This residue is chemically linked to the C-terminus of SEQ ID NO: 2059
GSLDESFYDWFERQLGKKKX

SEQ ID NO: 2059 - protein, 25 aa, Artificial Sequence
  Description of Artificial Sequence: Synthetic peptide
  MOD_RES (25): Ald
EWLDQEWAWVQCEVYGRGCPSEEKX

SEQ ID NO: 2060 - protein, 44 aa, Artificial Sequence
  Description of Artificial Sequence: Synthetic peptide
  MOD_RES (25)..(26): Ald
EWLDQEWAWVQCEVYGRGCPSEEKXXGSLDESFYDWFERQLGKK

SEQ ID NO: 2061 - protein, 19 aa, Artificial Sequence
  Description of Artificial Sequence: Synthetic peptide
  MOD_RES (1): Ald
XGSLDESFYDWFERQLGKK

SEQ ID NO: 2062 - protein, 25 aa, Artificial Sequence
  Description of Artificial Sequence: Synthetic peptide
  MOD_RES (1): Ald
XKEWLDQEWAWVQCEVYGRGCPSEE

SEQ ID NO: 2063 - protein, 42 aa, Artificial Sequence
  Description of Artificial Sequence: Synthetic peptide
WLDQEWAWVQCEVYGRGCPSGGSGGSGSLDESFYDWFERQLG

SEQ ID NO: 2064 - protein, 42 aa, Artificial Sequence; identical to SEQ ID NO: 2063
  Description of Artificial Sequence: Synthetic peptide

SEQ ID NO: 2065 - protein, 42 aa, Artificial Sequence
  Description of Artificial Sequence: Synthetic peptide
GSLDESFYDWFERQLGGGSGGSWLDQEWAWVQCEVYGRGCPS

SEQ ID NO: 2066 - protein, 44 aa, Artificial Sequence; identical to SEQ ID NO: 2060
  Description of Artificial Sequence: Synthetic peptide
  MOD_RES (25)..(26): Ald

SEQ ID NO: 2067 - protein, 44 aa, Artificial Sequence; identical to SEQ ID NO: 2060
  Description of Artificial Sequence: Synthetic peptide
  MOD_RES (25)..(26): Ald

SEQ ID NO: 2068 - protein, 31 aa, Artificial Sequence
  Description of Artificial Sequence: Synthetic peptide
LDQEWAWVQCEVYGRGCPSESFYDWFERQLG

SEQ ID NO: 2069 - protein, 38 aa, Artificial Sequence
  Description of Artificial Sequence: Synthetic peptide
HHHHHHKLDQEWAWVQCEVYGRGCPSESFYDWFERQLG

SEQ ID NO: 2070 - protein, 31 aa, Artificial Sequence; identical to SEQ ID NO: 2068
  Description of Artificial Sequence: Synthetic peptide

SEQ ID NO: 2071 - protein, 30 aa, Artificial Sequence
  Description of Artificial Sequence: Synthetic peptide
LDEWAWVQCVEYGRGCPSESFYDWFERQLG

SEQ ID NO: 2072 - protein, 30 aa, Artificial Sequence
  Description of Artificial Sequence: Synthetic peptide
LDQEWAVQCEVYGRGCPSESFYDWFERQLG

SEQ ID NO: 2073 - protein, 30 aa, Artificial Sequence
  Description of Artificial Sequence: Synthetic peptide
LDQEWAWVCEVYGRGCPSESFYDWFERQLG

SEQ ID NO: 2074 - protein, 30 aa, Artificial Sequence
  Description of Artificial Sequence: Synthetic peptide
LDQEWAWVQCVYGRGCPSESFYDWFERQLG

SEQ ID NO: 2075 - protein, 30 aa, Artificial Sequence
  Description of Artificial Sequence: Synthetic peptide
LDQEWAWVQCEVYGRCPSESFYDWFERQLG

SEQ ID NO: 2076 - protein, 30 aa, Artificial Sequence
  Description of Artificial Sequence: Synthetic peptide
LDQEWAWVQCEVYGRGCSESFYDWFERQLG

SEQ ID NO: 2077 - protein, 30 aa, Artificial Sequence
  Description of Artificial Sequence: Synthetic peptide
LDQEWAWVQCEVYGRGCPESFYDWFERQLG

SEQ ID NO: 2078 - protein, 29 aa, Artificial Sequence
  Description of Artificial Sequence: Synthetic peptide
LDQEWAWVQCEVYGRGCESFYDWFERQLG

SEQ ID NO: 2079 - protein, 30 aa, Artificial Sequence
  Description of Artificial Sequence: Synthetic peptide
LDQEWAWVQCEVYGRGCPSEFYDWFERQLG

SEQ ID NO: 2080 - protein, 30 aa, Artificial Sequence
  Description of Artificial Sequence: Synthetic peptide
LDQEWAWVQCEVYGRGCPSESFYDWFRQLG

SEQ ID NO: 2081 - protein, 23 aa, Artificial Sequence
  Description of Artificial Sequence: Synthetic peptide
EWLDQEWAWVQCEVYGRGCPSEE

SEQ ID NO: 2082 - protein, 31 aa, Artificial Sequence
  Description of Artificial Sequence: Synthetic peptide
ADQEWAWVQCEVYGRGCPSESFYDWFERQLG

SEQ ID NO: 2083 - protein, 30 aa, Artificial Sequence
  Description of Artificial Sequence: Synthetic peptide
LAQEWAWVQCEVYGRGCPSESFYDWFERQL

SEQ ID NO: 2084 - protein, 30 aa, Artificial Sequence
  Description of Artificial Sequence: Synthetic peptide
LDAEWAWVQCEVYGRGCPSESFYDWFERQL

SEQ ID NO: 2085 - protein, 30 aa, Artificial Sequence
  Description of Artificial Sequence: Synthetic peptide
LDQAWAWVQCEVYGRGCPSESFYDWFERQL

SEQ ID NO: 2086 - protein, 30 aa, Artificial Sequence
  Description of Artificial Sequence: Synthetic peptide
LDQEAAWVQCEVYGRGCPSESFYDWFERQL

SEQ ID NO: 2087 - protein, 30 aa, Artificial Sequence
  Description of Artificial Sequence: Synthetic peptide
LDQEWAAVQCEVYGRGCPSESFYDWFERQL

SEQ ID NO: 2088 - protein, 30 aa, Artificial Sequence
  Description of Artificial Sequence: Synthetic peptide
LDQEWAWAQCEVYGRGCPSESFYDWFERQL

SEQ ID NO: 2089 - protein, 30 aa, Artificial Sequence
  Description of Artificial Sequence: Synthetic peptide
LDQEWAWVACEVYGRGCPSESFYDWFERQL

SEQ ID NO: 2090 - protein, 30 aa, Artificial Sequence
  Description of Artificial Sequence: Synthetic peptide
LDQEWAWVQCAVYGRGCPSESFYDWFERQL

SEQ ID NO: 2091 - protein, 30 aa, Artificial Sequence
  Description of Artificial Sequence: Synthetic peptide
LDQEWAWVQCEAYGRGCPSESFYDWFERQL

SEQ ID NO: 2092 - protein, 30 aa, Artificial Sequence
  Description of Artificial Sequence: Synthetic peptide
LDQEWAWVQCEVAGRGCPSESFYDWFERQL

SEQ ID NO: 2093 - protein, 30 aa, Artificial Sequence
  Description of Artificial Sequence: Synthetic peptide
LDQEWAWVQCEVYARGCPSESFYDWFERQL

SEQ ID NO: 2094 - protein, 30 aa, Artificial Sequence
  Description of Artificial Sequence: Synthetic peptide
LDQEWAWVQCEVYGAGCPSESFYDWFERQL

SEQ ID NO: 2095 - protein, 30 aa, Artificial Sequence
  Description of Artificial Sequence: Synthetic peptide
LDQEWAWVQCEVYGRACPSESFYDWFERQL

SEQ ID NO: 2096 - protein, 30 aa, Artificial Sequence
  Description of Artificial Sequence: Synthetic peptide
LDQEWAWVQCEVYGRGCASESFYDWFERQL

SEQ ID NO: 2097 - protein, 30 aa, Artificial Sequence
  Description of Artificial Sequence: Synthetic peptide
LDQEWAWVQSEVYGRGSPSESFYDWFERQL

SEQ ID NO: 2098 - protein, 42 aa, Artificial Sequence
  Description of Artificial Sequence: Synthetic peptide
SLEEEWAQVECEVYGRGCPSGGSGGSGLLDESFYHWFDRQLR

SEQ ID NO: 2099 - protein, 47 aa, Artificial Sequence
  Description of Artificial Sequence: Synthetic peptide
WLDQEWAWVQCEVYGRGCPSGGSGGSGRVDWLQRNANFYDWFVAELG

SEQ ID NO: 2100 - protein, 44 aa, Artificial Sequence
  Description of Artificial Sequence: Synthetic peptide
WLDQEWAWVQCEVYGRGCPSGGSGGSSQAGSAFYAWFDQVLRTV

SEQ ID NO: 2101 - protein, 44 aa, Artificial Sequence
  Description of Artificial Sequence: Synthetic peptide
WLDQEWAWVQCEVYGRGCPSGGSGGSQSDAFYSGLWALIGLSDG

SEQ ID NO: 2102 - protein, 19 aa, Artificial Sequence
  Description of Artificial Sequence: Synthetic peptide
LDQEWAWVQCEVYGRGCPS

SEQ ID NO: 2103 - protein, 28 aa, Artificial Sequence
  Description of Artificial Sequence: Synthetic peptide
  MOD_RES (2): Acy
  MOD_RES (12): Tic
HXCLEEWGASLXQCSGSESFYDWFERQL

SEQ ID NO: 2104 - protein, 31 aa, Artificial Sequence
  Description of Artificial Sequence: Synthetic peptide
SIEEEWAQIKCDVWGRGCPSESFYDWFERQL

SEQ ID NO: 2105 - protein, 36 aa, Artificial Sequence
  Description of Artificial Sequence: Synthetic peptide
RLEEEWAWVQCEVYGRGCPSGSLDESFYDWFERQLG

SEQ ID NO: 2106 - protein, 36 aa, Artificial Sequence
  Description of Artificial Sequence: Synthetic peptide
SLEEEWAQVECEVYGRGCPSGSLDESFYDWFERQLG

SEQ ID NO: 2107 - protein, 36 aa, Artificial Sequence
  Description of Artificial Sequence: Synthetic peptide
SIEEEWAQIKCDVWGRGCPPGLLDESFYHWFDRQLR

SEQ ID NO: 2108 - protein, 35 aa, Artificial Sequence
  Description of Artificial Sequence: Synthetic peptide
HLCVLEELFWGASLFGYCSGGSLDESFYDWFERQL

SEQ ID NO: 2109 - protein, 41 aa, Artificial Sequence
  Description of Artificial Sequence: Synthetic peptide
HLCVLEELFWGASLFGYCSGGRVDWLQRNANFYDWFVAELG

SEQ ID NO: 2110 - protein, 35 aa, Artificial Sequence
  Description of Artificial Sequence: Synthetic peptide
WLDQEWAWVQCEVYGRGCPSDSDWAGYEWFEEQLD

SEQ ID NO: 2111 - protein, 43 aa, Artificial Sequence
  Description of Artificial Sequence: Synthetic peptide
HHHHHHKSLEEEWAQVECEVYGRGCPSGSLDESFYDWFERQLG

SEQ ID NO: 2112 - protein, 70 aa, Artificial Sequence
  Description of Artificial Sequence: Synthetic peptide
MADYKDDDDKGSLDESFYDWFERQLGKKGGSGGSGSLDESFYDWFERQLGKKAAAGAPVPYPDPLEPRPG

SEQ ID NO: 2113 - protein, 76 aa, Artificial Sequence
  Description of Artificial Sequence: Synthetic peptide
MADYKDDDDKGSLDESFYDWFERQLGKKGGSGGSGGSGGSGSLDESFYDWFERQLGKKAAAGAPVPYPDPLEPRPG

SEQ ID NO: 2114 - protein, 72 aa, Artificial Sequence
  Description of Artificial Sequence: Synthetic peptide
MADYKDDDDKGSLDESFYDWFERQLGKKGGSGGSWLDQEWAWVQCEVYGRGCPSAAAGAPVPYPDPLEPRPG

SEQ ID NO: 2115 - protein, 78 aa, Artificial Sequence
  Description of Artificial Sequence: Synthetic peptide
MADYKDDDDKGSLDESFYDWFERQLGKKGGSGGSGGSGGSWLDQEWAWVQCEVYGRGCPSAAAGAPVPYPDPLEPRPG

SEQ ID NO: 2116 - protein, 72 aa, Artificial Sequence
  Description of Artificial Sequence: Synthetic peptide
MADYKDDDDKWLDQEWAWVQCEVYGRGCPSGGSGGSGSLDESFYDWFERQLGKKAAAGAPVPYPDPLEPRPG

SEQ ID NO: 2117 - protein, 16 aa, Artificial Sequence
  Description of Artificial Sequence: Synthetic peptide
FHENFYDWFVQRVSKK

SEQ ID NO: 2118 - protein, 14 aa, Artificial Sequence
  Description of Artificial Sequence: Synthetic peptide
GGTVWPGYEWLRNA

SEQ ID NO: 2119 - protein, 41 aa, Artificial Sequence
  Description of Artificial Sequence: Synthetic peptide
HLCVLEELFWGASLFGYCSGGGSGGSGSLDESFYDWFERQL

SEQ ID NO: 2120 - protein, 47 aa, Artificial Sequence
  Description of Artificial Sequence: Synthetic peptide
HLCVLEELFWGASLFGYCSGGGSGGSGGSGGSGSLDESFYDWFERQL

SEQ ID NO: 2121 - protein, 47 aa, Artificial Sequence; identical to SEQ ID NO: 2099
  Description of Artificial Sequence: Synthetic peptide

SEQ ID NO: 2122 - protein, 53 aa, Artificial Sequence
  Description of Artificial Sequence: Synthetic peptide
WLDQEWAWVQCEVYGRGCPSGGSGGSGGSGGSGRVDWLQRNANFYDWFVAELG

SEQ ID NO: 2123 - protein, 47 aa, Artificial Sequence
  Description of Artificial Sequence: Synthetic peptide
HLCVLEELFWGASLFGYCSGGGSGGSGRVDWLQRNANFYDWFVAELG

SEQ ID NO: 2124 - protein, 53 aa, Artificial Sequence
  Description of Artificial Sequence: Synthetic peptide
HLCVLEELFWGASLFGYCSGGGSGGSGGSGGSGRVDWLQRNANFYDWFVAELG

SEQ ID NO: 2125 - protein, 44 aa, Artificial Sequence
  Description of Artificial Sequence: Synthetic peptide
HLCVLEELFWGASLFGYCSGGGSGGSSQAGSAFYAWFDQVLRTV

SEQ ID NO: 2126 - protein, 51 aa, Artificial Sequence
  Description of Artificial Sequence: Synthetic peptide
HLCVLEELFWGASLFGYCSGGGSGGSTFYSCLASLLTGTPQPNRGPWERCR

SEQ ID NO: 2127 - protein, 44 aa, Artificial Sequence
  Description of Artificial Sequence: Synthetic peptide
HLCVLEELFWGASLFGYCSGGGSGGSQSDAFYSGLWALIGLSDG

SEQ ID NO: 2128 - protein, 41 aa, Artificial Sequence
  Description of Artificial Sequence: Synthetic peptide
HLCVLEELFWGASLFGYCSGGGSGGSDSDWAGYEWFEEQLD

SEQ ID NO: 2129 - protein, 20 aa, Artificial Sequence
  Description of Artificial Sequence: Synthetic peptide
WLDQEWAWVQCEVYGRGCPS

SEQ ID NO: 2130 - protein, 18 aa, Artificial Sequence
  Description of Artificial Sequence: Synthetic peptide
SQAGSAFYAWFDQVLRTV

SEQ ID NO: 2131 - protein, 18 aa, Artificial Sequence
  Description of Artificial Sequence: Synthetic peptide
QSDAFYSGLWALIGLSDG

SEQ ID NO: 2132 - protein, 62 aa, Artificial Sequence
  Description of Artificial Sequence: Synthetic peptide
NNNNLGIEGRISEFIEGRAQPAMAWLDQEWAWVQCEVYGRGCPSAAAGAPVPYPDPLEPRAA

SEQ ID NO: 2133 - protein, 89 aa, Artificial Sequence
  Description of Artificial Sequence: Synthetic peptide
NNNNLGIEGRISEFIEGRAQPAMAWLDQEWAWVQCEVYGRGCPSGGSGGSKWLDQEWAWVQCEVYGRGCPSAAAGAPVPYPDPLEPRAA

SEQ ID NO: 2134 - protein, 74 aa, Artificial Sequence
  Description of Artificial Sequence: Synthetic peptide
NNNNLGIEGRISEFIEGRDYKDDDDKFHENFYDWFVRQVSGSGSLDALDRLMRYFEERPSLGAPVPYPDPLEPR

SEQ ID NO: 2135 - protein, 83 aa, Artificial Sequence
  Description of Artificial Sequence: Synthetic peptide
NNNNLGIEGRISEFIEGRDYKDDDKFHENFYDWFVRQVSGGSGGSHLCVLEELFWGASLFGYCSGAAAGAPVPYPDPLEPRAA

SEQ ID NO: 2136 - protein, 89 aa, Artificial Sequence
  Description of Artificial Sequence: Synthetic peptide
NNNNLGIEGRISEFIEGRDYKDDDKFHENFYDWFVRQVSGGSGGSGGSGGSHLCVLEELFWGASLFGYCSGAAAGAPVPYPDPLEPRAA

SEQ ID NO: 2137 - protein, 86 aa, Artificial Sequence
  Description of Artificial Sequence: Synthetic peptide
NNNNLGIEGRISEFIEGRDYKDDDKFHENFYDWFVRQVSGGSGGSGGSHLCVLEELFWGASLFGYCSGAAAGAPVPYPDPLEPRAA

SEQ ID NO: 2138 - protein, 94 aa, Artificial Sequence
  Description of Artificial Sequence: Synthetic peptide
NNNNLGIEGRISEFIEVRAQPAMARGGGTFYEWFESALRKHGAGGGSGGSGGSGGSRGGGTFYEWFESALRKHGAGAAAGAPVPYPDPLEPRAA

SEQ ID NO: 2139 - protein, 79 aa, Artificial Sequence
  Description of Artificial Sequence: Synthetic peptide
NNNNLGIEGRISEFIEGRAQPAMAFHENFYDWFVRQVSGGSGGSGGSFHENFYDWFVRQVSAAAGAPVPYPDPLEPRAA

SEQ ID NO: 2140 - protein, 56 aa, Artificial Sequence
  Description of Artificial Sequence: Synthetic peptide
NNNNLGIEGRISEFIEGRAQPAMAFHENFYDWFVRQVSAAAGAPVPYPDPLEPRAA

SEQ ID NO: 2141 - protein, 88 aa, Artificial Sequence
  Description of Artificial Sequence: Synthetic peptide
NNNNLGIEGRISEFIEGRAQPAMARGGGTFYEWFESTLRKHGAGGGSGGSRGGGTFYEWFESALRKHGAGAAAGAPVPYPDPLEPRAA

SEQ ID NO: 2142 - protein, 90 aa, Artificial Sequence
  Description of Artificial Sequence: Synthetic peptide
NNNNLGIEGRISEFIEGRAQPAMAFHENFYDWFVRQVSGGSFHENFYDWFVRQVSGGSFHENFYDWFVRQVSAAAGAPVPYPDPLEPRAA

SEQ ID NO: 2143 - protein, 73 aa, Artificial Sequence
  Description of Artificial Sequence: Synthetic peptide
NNNNLGIEGRISEFIEGRAQPAMAFHENFYDWFVRQVSGGSGGSFHENFYDWFVRQVSGAPVPYPDPLEPRAA

SEQ ID NO: 2144 - protein, 88 aa, Artificial Sequence
  Description of Artificial Sequence: Synthetic peptide
NNNNLGIEGRISEFIEGRAQPAMAFHENFYDWFVRQVSGGSGGSGGSGGSAQPAMAFHENFYDWFVRQVSAAAGAPVPYPDPLEPRAA

SEQ ID NO: 2145 - protein, 62 aa, Artificial Sequence
  Description of Artificial Sequence: Synthetic peptide
NNNNLGIEGRISEFIEGRAQPAMARGGGTFYEWFESALRKHGAGAAAGAPVPYPDPLEPRAA

SEQ ID NO: 2146 - protein, 73 aa, Artificial Sequence
  Description of Artificial Sequence: Synthetic peptide
NNNNLGIEGRISEFIEGRAQPAMAFHENFYDWFVRQVSGGSFHENFYDWFVRQVSAAAGAPVPYPDPLEPRAA

SEQ ID NO: 2147 - protein, 57 aa, Artificial Sequence
  Description of Artificial Sequence: Synthetic peptide
NNNNLGIEGRISEFIEGRDYKDDDDKFHENFYDWFVRQVSAAGAPVPYPDPLEPRAA

SEQ ID NO: 2148 - protein, 64 aa, Artificial Sequence
  Description of Artificial Sequence: Synthetic peptide
NNNNLGIEGRISEFIEGRDYKDDDDKHLCVLEELFWGASLFGYCSGAAAGAPVPYPDPLEPRAA

SEQ ID NO: 2149 - protein, 56 aa, Artificial Sequence
  Description of Artificial Sequence: Synthetic peptide
NNNNLGIEGRISEFGSADYKDLDALDRLMRYFEERPSLAAAGAPVPYPDPLEPRAA

SEQ ID NO: 2150 - protein, 83 aa, Artificial Sequence; identical to SEQ ID NO: 2135
  Description of Artificial Sequence: Synthetic peptide

SEQ ID NO: 2151 - protein, 65 aa, Artificial Sequence
  Description of Artificial Sequence: Synthetic peptide
DYKDDDKFHENFYDWFVRQVSGGSGGSHLCVLEELFWGASLFGYCSGAAAGAPVPYPDPLEPRAA

SEQ ID NO: 2152 - protein, 89 aa, Artificial Sequence; identical to SEQ ID NO: 2136
  Description of Artificial Sequence: Synthetic peptide

SEQ ID NO: 2153 - protein, 71 aa, Artificial Sequence
  Description of Artificial Sequence: Synthetic peptide
DYKDDDKFHENFYDWFVRQVSGGSGGSGGSGGSHLCVLEELFWGASLFGYCSGAAAGAPVPYPDPLEPRAA

SEQ ID NO: 2154 - protein, 86 aa, Artificial Sequence; identical to SEQ ID NO: 2137
  Description of Artificial Sequence: Synthetic peptide

SEQ ID NO: 2155 - protein, 68 aa, Artificial Sequence
  Description of Artificial Sequence: Synthetic peptide
DYKDDDKFHENFYDWFVRQVSGGSGGSGGSHLCVLEELFWGASLFGYCSGAAAGAPVPYPDPLEPRAA

SEQ ID NO: 2156 - protein, 18 aa, Artificial Sequence
  Description of Artificial Sequence: Synthetic peptide
LCQRLGVGWPGWLSGWCA

SEQ ID NO: 2157 - protein, 17 aa, Artificial Sequence
  Description of Artificial Sequence: Synthetic peptide
LCQSWGVRIGWLTGLCP

SEQ ID NO: 2158 - protein, 62 aa, Artificial Sequence; identical to SEQ ID NO: 2132
  Description of Artificial Sequence: Synthetic peptide

SEQ ID NO: 2159 - protein, 89 aa, Artificial Sequence; identical to SEQ ID NO: 2133
  Description of Artificial Sequence: Synthetic peptide

SEQ ID NO: 2160 - protein, 64 aa, Artificial Sequence; identical to SEQ ID NO: 2148
  Description of Artificial Sequence: Synthetic peptide

SEQ ID NO: 2161 - protein, 90 aa, Artificial Sequence
  Description of Artificial Sequence: Synthetic peptide
NNNNLGIEGRISEFIEGRDYKDDDDKHLCVLEELFWGASLFGYCSGGGSGGSHLCVLEELFWGASLFGYCSGAAAGAPVPYPDPLEPRAA

SEQ ID NO: 2162 - protein, 96 aa, Artificial Sequence
  Description of Artificial Sequence: Synthetic peptide
NNNNLGIEGRISEFIEGRDYKDDDDKHLCVLEELFWGASLFGYCSGGGSGGSGGSGGSHLCVLEELFWGASLFGYCSGAAAGAPVPYPDPLEPRAA

SEQ ID NO: 2163 - protein, 116 aa, Artificial Sequence
  Description of Artificial Sequence: Synthetic peptide
NNNNLGIEGRISEFIEGRDYKDDDDKHLCVLEELFWGASLFGYCSGGGSGGSHLCVLEELFWGASLFGYCSGGGSGGSHLCVLEELFWGASLFGYCSGAAAGAPVPYPDPLEPRAA

SEQ ID NO: 2164 - protein, 56 aa, Artificial Sequence; identical to SEQ ID NO: 2140
  Description of Artificial Sequence: Synthetic peptide

SEQ ID NO: 2165 - protein, 73 aa, Artificial Sequence; identical to SEQ ID NO: 2146
  Description of Artificial Sequence: Synthetic peptide

SEQ ID NO: 2166 - protein, 71 aa, Artificial Sequence
  Description of Artificial Sequence: Synthetic peptide
NNNNLGIEGRISEFIEGRAQPAMAFHENFYDWFVRQVSGGSGGSFHENFYDWFVRQVSGAPVPYPDPLEPR

SEQ ID NO: 2167 - protein, 79 aa, Artificial Sequence; identical to SEQ ID NO: 2139
  Description of Artificial Sequence: Synthetic peptide

SEQ ID NO: 2168 - protein, 88 aa, Artificial Sequence; identical to SEQ ID NO: 2144
  Description of Artificial Sequence: Synthetic peptide

SEQ ID NO: 2169 - protein, 90 aa, Artificial Sequence; identical to SEQ ID NO: 2142
  Description of Artificial Sequence: Synthetic peptide

SEQ ID NO: 2170 - protein, 65 aa, Artificial Sequence
  Description of Artificial Sequence: Synthetic peptide
NNNNLGIEGRISEFIEGRDYKDDDDKVRVDWLQRNANFYDWFVAELVAAAGAPVPYPDPLEPRAA

SEQ ID NO: 2171 - protein, 92 aa, Artificial Sequence
  Description of Artificial Sequence: Synthetic peptide
NNNNLGIEGRISEFIEGRDYKDDDDKVRVDWLQRNANFYDWFVAELGGGSGGSGRVDWLQRNANFYDWFVAELGAAAGAPVPYPDPLEPRAA

SEQ ID NO: 2172 - protein, 98 aa, Artificial Sequence
  Description of Artificial Sequence: Synthetic peptide
NNNNLGIEGRISEFIEGRDYKDDDDKVRVDWLQRNANFYAWFVAELGGGSGGSGGSGGSGRVDWLQRNANFYDWFVAELGAAAGAPVPYPDPLEPRAA

SEQ ID NO: 2173 - protein, 62 aa, Artificial Sequence; identical to SEQ ID NO: 2145
  Description of Artificial Sequence: Synthetic peptide

SEQ ID NO: 2174 - protein, 88 aa, Artificial Sequence; identical to SEQ ID NO: 2141
  Description of Artificial Sequence: Synthetic peptide

SEQ ID NO: 2175 - protein, 94 aa, Artificial Sequence; identical to SEQ ID NO: 2138
  Description of Artificial Sequence: Synthetic peptide

SEQ ID NO: 2176 - protein, 61 aa, Artificial Sequence
  Description of Artificial Sequence: Synthetic peptide
NNNNLGIEGRISEFIEGRDYKDDDDKGSLDESFYDWFERQLGKKAAGAPVPYPDPLEPRAA

SEQ ID NO: 2177 - protein, 86 aa, Artificial Sequence
  Description of Artificial Sequence: Synthetic peptide
NNNNLGIEGRISEFIEGRDYKDDDDKGSLDESFYDWFERQLGKKGGSGGSGSLDESFYDWFERQLGKKAAAGAPVPYPDPLEPRAA

SEQ ID NO: 2178 - protein, 92 aa, Artificial Sequence
  Description of Artificial Sequence: Synthetic peptide
NNNNLGIEGRISEFIEGRDYKDDDDKGSLDESFYDWFERQLGKKGGSGGSGGSGGSGSLDESFYDWFERQLGKKAAAGAPVPYPDPLEPRAA

SEQ ID NO: 2179 - protein, 57 aa, Artificial Sequence; identical to SEQ ID NO: 2147
  Description of Artificial Sequence: Synthetic peptide

SEQ ID NO: 2180 - protein, 64 aa, Artificial Sequence; identical to SEQ ID NO: 2148
  Description of Artificial Sequence: Synthetic peptide

SEQ ID NO: 2181 - protein, 56 aa, Artificial Sequence; identical to SEQ ID NO: 2149
  Description of Artificial Sequence: Synthetic peptide

SEQ ID NO: 2182 - protein, 76 aa, Artificial Sequence
  Description of Artificial Sequence: Synthetic peptide
NNNNLGIEGRISEFIEGRDYKDDDDKFHENFYDWFVRQVSGGSGGSLDALDRLMRYFEERPSLGAPVPYPDPLEPR

SEQ ID NO: 2183 - protein, 60 aa, Artificial Sequence
  Description of Artificial Sequence: Synthetic peptide
DYKDDDKFHENFYDWFVRQVSGSGSLDALDRLMRYFEERPSLAAAGAPVPYPDPLEPRAA

SEQ ID NO: 2184 - protein, 83 aa, Artificial Sequence; identical to SEQ ID NO: 2135
  Description of Artificial Sequence: Synthetic peptide

SEQ ID NO: 2185 - protein, 65 aa, Artificial Sequence; identical to SEQ ID NO: 2151
  Description of Artificial Sequence: Synthetic peptide

SEQ ID NO: 2186 - protein, 89 aa, Artificial Sequence; identical to SEQ ID NO: 2136
  Description of Artificial Sequence: Synthetic peptide

SEQ ID NO: 2187 - protein, 71 aa, Artificial Sequence; identical to SEQ ID NO: 2153
  Description of Artificial Sequence: Synthetic peptide

SEQ ID NO: 2188 - protein, 86 aa, Artificial Sequence; identical to SEQ ID NO: 2137
  Description of Artificial Sequence: Synthetic peptide

SEQ ID NO: 2189 - protein, 74 aa, Artificial Sequence
  Description of Artificial Sequence: Synthetic peptide
DYKDDDDKVRVDWLQRNANFYDWFVAELGGGSGGSGRVDWLQRNANFYDWFVAELGAAAGAPVPYPDPLEPRSA

SEQ ID NO: 2190 - protein, 80 aa, Artificial Sequence
  Description of Artificial Sequence: Synthetic peptide
DYKDDDDKVRVDWLQRNANFYAWFVAELGGGSGGSGGSGGSGRVDWLQRNANFYDWFVAELGAAAGAPVPYPDPLEPRAA

SEQ ID NO: 2191 - protein, 46 aa, Artificial Sequence
  Description of Artificial Sequence: Synthetic peptide
DYKDDDDKHLCVLEELFWGASLFGYCSGAAAGAPVPYPDPLEPRAA

SEQ ID NO: 2192 - protein, 72 aa, Artificial Sequence
  Description of Artificial Sequence: Synthetic peptide
DYKDDDDKHLCVLEELFWGASLFGYCSGGGSGGSHLCVLEELFWGASLFGYCSGAAAGAPVPYPDPLEPRAA

SEQ ID NO: 2193 - protein, 70 aa, Artificial Sequence; identical to SEQ ID NO: 2112
  Description of Artificial Sequence: Synthetic peptide

SEQ ID NO: 2194 - protein, 76 aa, Artificial Sequence; identical to SEQ ID NO: 2113
  Description of Artificial Sequence: Synthetic peptide

SEQ ID NO: 2195 - protein, 48 aa, Artificial Sequence
  Description of Artificial Sequence: Synthetic peptide
MADYKDDDDKWLDQEWAWVQCEVYGRGCPSAAAGAPVPYPDPLEPRPG

SEQ ID NO: 2196 - protein, 72 aa, Artificial Sequence; identical to SEQ ID NO: 2116
  Description of Artificial Sequence: Synthetic peptide

SEQ ID NO: 2197 - protein, 72 aa, Artificial Sequence; identical to SEQ ID NO: 2114
  Description of Artificial Sequence: Synthetic peptide

SEQ ID NO: 2198 - protein, 78 aa, Artificial Sequence; identical to SEQ ID NO: 2115
  Description of Artificial Sequence: Synthetic peptide

SEQ ID NO: 2199 - protein, 74 aa, Artificial Sequence
  Description of Artificial Sequence: Synthetic peptide
MADYKDEIEAEWGRVRCLVYGRCVGGGGSGGSGGSGGSGSLDESFYDWFERQLGKKAAAGAPVPYPDPLEPRPG

SEQ ID NO: 2200 - protein, 81 aa, Artificial Sequence
  Description of Artificial Sequence: Synthetic peptide
MADYKDDDDKWLDQEWAWVQCEVYGRGCPSQPPPPDITTHRADPQGSLDESFYDWFERQLGKKAAAGAPVPYPDPLEPRPG

SEQ ID NO: 2201 - protein, 79 aa, Artificial Sequence
  Description of Artificial Sequence: Synthetic peptide
MADYKDDDDKWLDQEWAWVQCEVYGRGCPSTPKPPTPPPLSADGSLDESFYDWFERQLGKKAAAGAPVPYPDPLEPRPG

SEQ ID NO: 2202 - protein, 29 aa, Artificial Sequence
  Description of Artificial Sequence: Synthetic peptide
MQNDDGSLDESFYDWFERQLGHHHHHHPG

SEQ ID NO: 2203 - protein, 31 aa, Artificial Sequence
  Description of Artificial Sequence: Synthetic peptide
MGSLDESFYDWFERQLGEEEGGDHHHHHHPG

SEQ ID NO: 2204 - protein, 35 aa, Artificial Sequence
  Description of Artificial Sequence: Synthetic peptide
MQNDDGSLDESFYDWFERQLGEEEGGDHHHHHHPG

SEQ ID NO: 2205 - protein, 13 aa, Artificial Sequence
  Description of Artificial Sequence: Synthetic peptide
GAPVPYPDPLEPR

SEQ ID NO: 2206 - protein, 20 aa, Artificial Sequence
  Description of Artificial Sequence: Synthetic peptide
WLDQERAWLWCEISGRGCLS

SEQ ID NO: 2207 - protein, 43 aa, Artificial Sequence
  Description of Artificial Sequence: Synthetic peptide
LDQERAWLWCEISGRGCLSGGSGGSGSLDESFYDWFERQLGKK

SEQ ID NO: 2208 - protein, 50 aa, Artificial Sequence
  Description of Artificial Sequence: Synthetic peptide
WLDQERAWLWCEISGRGCLSGGSGGSGGSGGSGSLDESFYDWFERQLGKK

SEQ ID NO: 2209 - protein, 24 aa, Artificial Sequence
  Description of Artificial Sequence: Synthetic peptide
DYKDFYDAIDQLVRGSARAGGTRD

SEQ ID NO: 2210 - protein, 52 aa, Artificial Sequence
  Description of Artificial Sequence: Synthetic peptide
WLDQERAWLWCEISGRGCLSGGSGGSGIISQSCPESFYDWFAGQVSDPWWCW

SEQ ID NO: 2211 - protein, 44 aa, Artificial Sequence
  Description of Artificial Sequence: Synthetic peptide
WLDQERAWLWCEISGRGCLSGGSGGSGSLDESFYDWFERQLGKK

SEQ ID NO: 2212 - protein, 50 aa, Artificial Sequence; identical to SEQ ID NO: 2208
  Description of Artificial Sequence: Synthetic peptide

SEQ ID NO: 2213 - protein, 36 aa, Artificial Sequence
  Description of Artificial Sequence: Synthetic peptide
GLDQEQAWVECEVYGRGCPYGSLDESFYDWFERQLG

SEQ ID NO: 2214 - protein, 42 aa, Artificial Sequence
  Description of Artificial Sequence: Synthetic peptide
RLEEEWAWVQCEVYGRGCPSGGSGGSGSLDESFYDWFERQLG

SEQ ID NO: 2215 - protein, 42 aa, Artificial Sequence
  Description of Artificial Sequence: Synthetic peptide
SLDREWACVKCEVYGRGCPCGGSGGSGSLDESFYDWFERQLG

SEQ ID NO: 2216 - protein, 42 aa, Artificial Sequence
  Description of Artificial Sequence: Synthetic peptide
SLEEEWAQVECEVYGRGCPSGGSGGSGSLDESFYDWFERQLG

SEQ ID NO: 2217 - protein, 42 aa, Artificial Sequence; identical to SEQ ID NO: 2098
  Description of Artificial Sequence: Synthetic peptide

SEQ ID NO: 2218 - protein, 42 aa, Artificial Sequence
  Description of Artificial Sequence: Synthetic peptide
SIEEEWAQIKCDVWGRGCPPGGSGGSGLLDESFYHWFDRQLR

SEQ ID NO: 2219 - protein, 37 aa, Artificial Sequence
  Description of Artificial Sequence: Synthetic peptide
QLDLEWAWVQCEVYGRGCGGSGSLDESFYDWFERQLG

SEQ ID NO: 2220 - protein, 33 aa, Artificial Sequence
  Description of Artificial Sequence: Synthetic peptide
QLDEEWAGVQCEVYGRGCSLDESFYDWFERQLG

SEQ ID NO: 2221 - protein, 42 aa, Artificial Sequence
  Description of Artificial Sequence: Synthetic peptide
RLEEEWRWVQCEVYGRGCAAGGSGGSGSLDESFYDWFERQLG

SEQ ID NO: 2222 - protein, 41 aa, Artificial Sequence
  Description of Artificial Sequence: Synthetic peptide
SLDQEWAWVQCEVYGRGCPSGGSGGSDSDWAGYEWFEEQLD

SEQ ID NO: 2223 - protein, 16 aa, Artificial Sequence
  Description of Artificial Sequence: Synthetic peptide
  MOD_RES (6): Asp or Leu
GLADEXFYEWFERQLR

SEQ ID NO: 2224 - protein, 16 aa, Artificial Sequence
  Description of Artificial Sequence: Synthetic peptide
  MOD_RES (9): Glu or Ala
GQLDEDFYXWFDRQLS

SEQ ID NO: 2225 - protein, 16 aa, Artificial Sequence
  Description of Artificial Sequence: Synthetic peptide
  MOD_RES (3): Met or Trp
  MOD_RES (9): Glu or Ala
GFXDESFYXWFERQLR

SEQ ID NO: 2226 - protein, 20 aa, Artificial Sequence
  Description of Artificial Sequence: Synthetic peptide
  MOD_RES (14): Tyr or Trp
SLEEEWAQIECEVXGRGCPS

SEQ ID NO: 2227 - protein, 20 aa, Artificial Sequence
  Description of Artificial Sequence: Synthetic peptide
WLDQEWVQCEVYGRGCPSKK

What is claimed is:

1. A method of decreasing insulin receptor activity in mammalian cells comprising administering to said cells an amino acid sequence in an amount sufficient to decrease insulin activity, wherein the amino acid sequence comprises a subsequence that binds to Site 1 of insulin receptor and a subsequence that binds to Site 2 of insulin receptor, wherein the Site 1 sequence consists essentially of a Formula 1 sequence $X_1X_2X_3X_4X_5$ and the Site 2 sequence consists essentially of a Formula 6 sequence $X_{62}X_{63}X_{64}X_{65}X_{66}X_{67}X_{68}X_{69}X_{70}X_{71}X_{72}X_{73}X_{74}X_{75}X_{76}X_{77}X_{78}X_{79}X_{80}X_{81}$, wherein $X_1$, $X_2$, $X_4$, and $X_5$ are aromatic amino acids;

$X_3$ is any polar amino;

$X_{62}$, $X_{65}$, $X_{66}$ $X_{68}$, $X_{69}$, $X_{71}$, $X_{73}$, $X_{76}$, $X_{77}$, $X_{78}$, $X_{80}$ and $X_{81}$ are any amino acid;

$X_{63}$, $X_{70}$, and $X_{74}$ are hydrophobic amino acids;

$X_{64}$, is a polar amino acid;

$X_{67}$ and $X_{75}$ are aromatic amino acids; $X_{72}$ and $X_{79}$ are cysteines;

the subsequences are linked C-terminus to N-terminus; and the subsequences are oriented Site 2 to Site 1, with the proviso that the amino acid sequence is not insulin, insulin-like growth factor, or fragments thereof.

2. The method according to claim 1, wherein $X_1$, $X_2$, and $X_5$ are selected from the group consisting of phenylalanine and tyrosine, $X_3$ is selected from the group consisting of aspartic acid, glutamic acid, glycine and serine, and $X_4$ is selected from group consisting of tryptophan, tyrosine and phenylalanine.

3. The method according to claim 1, wherein $X_{63}$ is selected from the group consisting of leucine, isoleucine, methionine and valine; $X_{70}$ and $X_{74}$ are selected from group consisting of valine, isoleucine, leucine and methionine; $X_{64}$ is selected from group consisting of aspartic aid and glutamic acid; $X_{67}$ is tryptophan; and $X_{75}$ is selected from group consisting of tyrosine and tryptophan.

4. The method according to claim 1; wherein the Formula 1 sequence $X_1 X_2X_3X_4X_5$ is FYDWF (SEQ ID NO: 1554).

5. The method according to claim 1, wherein the Formula 6 sequence $X_{62}X_{63}X_{64}X_{65}X_{66}X_{67}X_{68}X_{69}X_{70}X_{71}X_{72}X_{73}X_{74}X_{75}X_{76}X_{77}X_{78}X_{79}X_{80}X_{81}$ is WLDQE WAWVQCEVYGRGCPS (SEQ ID NO:2129).

6. The method according to claim 1, wherein the Formula 1 sequence is selected from the group consisting of sequences SEQ ID NOS: 1–712 (FIGS. 1A–1O); SEQ ID NOS: 1221–1243 (FIG. 8); and SEQ ID NOS: 1596, 1718–1719, 1556, 1560, and 17201776 (Table 2).

7. The method according to claim 1, wherein the Formula 6 sequence is selected from the group consisting of sequences SEQ ID NOS: 926–1061 (FIGS. 3A–3E); SEQ ID NOS: 1244–1253 (FIG. 9A); and SEQ ID NOS: 1596, 1718–1719, 1556, 1560, and 17201776 (Table 2).

8. The method according to claim 1, wherein the Formula 1 sequence is selected from the group consisting of sequences S105–S116 (SEQ ID NOS: 1791–1805, 1556, and 18061807), S131 (SEQ ID NO:1820), S137 (SEQ ID NO:1%21), S158 (SEQ ID NO:1780), S165–S168 (SEQ ID NOS: 1554, and 1824–1826), S171 (SEQ ID NO:1831), S175--S176 (SEQ ID NOS: 1560 and 1836), S179–S184 (SEQ ID NOS: 1839–1844), S214–216 (SEQ ID NOS: 1845–1847), S219–223 (SEQ ID NOS: 1852–1856). S227 (SEQ D NO:1858), S234245 (SEQ ID NOS: 1869–1880), S248S251 (SEQ D NOS: 1883–1886), S264–S265 (SEQ ID NOS: 1900–1901), S268 (SEQ ID NO:1903), S278 (SEQ ID NO:1905), S287 (SEQ ID NO:1911), S294–S295 (SEQ ID NOS: 1922–1923), S315 (SEQ ID NO:1937), S319–322 (SEQ ID NOS: 19401943), S326 (SEQ ID NO:1600), S342 (SEQ ID NO:1962), S365–S366 (SEQ TD NOS:1987–1988), S371–S373 (SEQ ID NOS:1558, and 1990–1991), S386–S403 (SEQ ID NOS:1559, 2005–2007, 1794, 2008–2009, 1788, 1787, 1789, 2010–2011, 1791, and 2012–2014), RB437 (SEQ ID NO:2164), RB502 (SEQ ID NO:2170), RB452 (SEQ ID NO:2173), RB513 (SEQ ID NO:2176), RB464 (SEQ ID NO:2179), RB596 (SEQ ID NO:2202), RB569 (SEQ ID NO:2203), and RB570 (SEQ ID NO:2204).

9. The method according to claim 1, wherein the Formula 6 sequence is selected from the group consisting of sequences S256 (SEQ ID NO:1893), S263 (SEQ ID NO:1899), S266 (SEQ ID NO:1902), S284–285 (SEQ ID NOS:1909–1910), S515 (SEQ ID NO:2102), and RB426 (SEQ ID NO:215R).

10. The method according to claim 1, wherein the Formula 1 sequence is selected from the group consisting of sequences H2C/D117: FHENFYDWFVRQVSKK (SEQ ID NO:1556); FHENFYDWFVRQVS (SEQ ID NO:1557); RP9: GSLDESFYDWFERQLGKK (SEQ ID NO:1558); GSLDESFYDWFERQLG (SEQ ID NO:1559); GLADEDFYEWFERQLR (SEQ ID NO:1561); GLADELFYEWFDRQLS (SEQ ID NO: 1562); GQLDEDFYEWFDRQLS (SEQ ID NO: 1563); GQLDEDFYAWFDRQLS (SEQ ID NO:1564); GFM-DESFYEWFERQLR (SEQ ID NO:1565); GFWDES-FYAWFERQLR (SEQ ID NO:1566); GFMDES-FYAWFERQLR (SEQ ID NO: 1567); GFWDESFYEWFERQLR (SEQ ID NO:1568); RP15: SQAGSAFYAWFDQVLRTV (SEQ ID NO:2130); and S175: GRVDWLQRNANFYDWFVAELG (SEQ ID NO:1560).

11. The method according to claim 1, wherein the Formula 6 sequence is a D8 sequence selected from the group consisting of:

WLDQEWVQCEVYGRGCPSKK (SEQ ID NO:2227); KWLDQEWAWVQCEVYGRGCPSKK (SEQ ID

NO:1579); KWLDQEWAWVQCEVYGRGCPS (SEQ ID NO:1580); SLEEWAQIQCEIYGRGCRY (SEQ ID NO:1581); SLEEEWAQIQCEIWGRGCRY (SEQ ID NO:1582); SLEEEWAQIECEVYGRGCPS (SEQ ID NO:1583); and SLEEWAQIECEVWGRGCPS (SEQ ID NO:1584).

12. The method according to claim 1, wherein the amino acid sequence is selected from the group consisting of sequences 537–538 (SEQ ID NOS:2114–2115).

13. The method according to claim 1, wherein the amino acid sequence is selected from the group consisting of sequences S425 (SEQ ID NO:2031), S454 (SEQ ID NOS:2058–2059), S459 (SEQ D NO:2065), and RB537–RB538 (SEQ ID NOS:2197–2198).

14. An amino acid sequence, that is in an insulin receptor agonist which comprises (a) a subsequence that binds to Site 1 of the insulin receptor that consists essentially of a Formula 1 sequence $X_1X_2X_3X_4X$ and (b) a subsequence that binds to Site 2 of the insulin receptor that consists essentially of a Formula 6 sequence $X_{62}$ $X_{63}X_{64}X_{65}X_{66}X_{67}X_{68}X_{69}X_{70}X_{71}X_{72}X_{73}X_{74}X_{75}X_{76}X_{77}X_{78}X_{79}X_{80}X_{81}$, wherein $X_1$, $X_2$, $X_4$, and $X_5$ are aromatic amino acids;
$X_3$ is any polar amino acid;
$X_{62}$, $X_{65}$, $X_{66}$, $X_{68}$, $X_{69}$, $X_{71}$, $X_{73}$, $X_{76}$, $X_{77}$, $X_{78}$, $X_{80}$ and $X_{81}$ are any amino acid;
$X_{63}$, $X_{70}$, and $X_{74}$ are hydrophobic amino acids;
$X_{64}$ is a polar amino acid;
$X_{67}$ and $X_{75}$ are aromatic amino acids;
$X_{72}$ and $X_{79}$ are cysteines;
the subsequences are linked C-terminus to N-terminus; and
the subsequences are oriented Site 2 to Site 1,
with the proviso that the acid sequence is not insulin, insulin-like growth factor, or fragments thereof.

15. The amino acid sequence according to claim 14, wherein $X_1$, $X_2$, and $X_5$ are selected from the group consisting of phenylalanine and tyrosine, $X_3$ is selected from the group consisting of aspartic acid, glutamic acid, glycine and serine, and $X_4$ is selected from group consisting of tryptophan, tyrosine and phenylalanine.

16. The amino acid sequence according to claim 14, wherein $X_{63}$ is selected from the group consisting of leucine, isoleucine, methionine and valine; $X_{70}$ and $X_{74}$ are selected from group consisting of valine, isoleucine, leucine and methionine; $X_{64}$ is selected from group consisting of aspartic acid and glutamic acid; $X_{67}$ is tryptophan; and $X_{75}$ is selected from group consisting of tyrosine and tryptophan.

17. The amino acid sequence according to claim 14, wherein the Formula 1 sequence $X_1$ $X_2X_3X_4X_5$ is FYDWF (SEQ ID NO: 1554).

18. The amino acid sequence according to claim 14, wherein the Formula 6 sequence $X_{62}X_{63}X_{64}X_{65}X_{66}X_{67}X_{68}X_{69}X_{70}X_{71}X_{72}X_{73}X_{74}X_{75}X_{76}X_{77}X_{78}X_{79}X_{80}X_{81}$ is WLDQEWAWVQCEVYGROCPS (SEQ ID NO:2056).

19. The amino acid sequence according to claim 14, wherein the Formula 1 sequence is selected from the group consisting of sequences SEQ ID NOS: 1–712 (FIGS. 1A–10); SEQ ID NOS:1221–1243 (FIG. 8); and SEQ ID NOS:1596, 1718–1719, 1556, 1560, and 1720–1776 (Table 2).

20. The amino acid sequence according to claim 14, wherein the Formula 6: sequence is selected from the group consisting of sequences SEQ ID NOS:926–1061 (FIGS. 3A–3E); SEQ ID NOS:1244–1253 (FIG. 9A); and SEQ ID NOS:1596, 1718–1719, 1556, 1560, and 1720–1776 (Table 2).

21. The amino acid sequence according to claim 14, wherein the Formula 1 sequence is selected from the group consisting of sequences S 10S—S116 (SEQ ID NOS:1791–1805, 1556, and 1806–1807), S 131 (SEQ ID NO:1820), S137 (SEQ ID NO:1821), S158 (SEQ ID NO:1780), S165–S168 (SEQ ID NOS:1554, and 1824–1826), S171 (SEQ ID NO:1831), S175–S176 (SEQ ID NOS:1560 and 1836), S179–S184 (SEQ ID NOS:1839–1844), S214–216 (SEQ ID NOS:1845–1847), S219–223 (SEQ ID NOS:1852–1856), S227 (SEQ ID NO:1858), S234–245 (SEQ ID NOS:1869–1880), S248–S251(SEQ ID NOS:1883–1886), S264S265 (SEQ ID NOS:1990–1901), S268 (SEQ ID NO: 1903), S278 (SEQ ID NO: 1905), S287 (SEQ ID NO:1911), S294–S295 (SEQ ID NOS:1922–1923), S315 (SEQ ID NO:1937), S319–322 (SEQ ID NOS:1940–1943), S326 (SEQ ED NO:1600), S342 (SEQ ID NO:1962), S365–S366 (SEQ ID NOS:1987–1988), S371–S373 (SEQ ID NOS:1558, 1990–1991), S386S403 (SEQ ID NOS:1559, 2005–2007, 1794, 2008–2009, 1788, 1787, 1789, 2010–2011, 1791, and 2012–2014), RB437 (SEQ ID NO:2164), RB502 (SEQ ID NO:2170), RB452 (SEQ ID NO:2173), RB513 (SEQ ID NO:2176). RB464 (SEQ ID NO:2179), RB596 (SEQ ID NO:2202), RB569 (SEQ ID NO:2203), and RB570 (SEQ ID NO:2204).

22. The amino acid sequence according to claim 14, wherein the Formula 6 sequence is selected from the group consisting of sequences S256 (SEQ ID NO:1893), S263 (SEQ ID NO:1899), S266 (SEQ ID NO:1902), S284285 (SEQ ID NOS:1909–1910), S515 (SEQ ID NO:2102), and RB426 (SEQ ID NO:2158).

23. The amino acid sequence according to claim 14, wherein the Formula 1 sequence is selected from the group consisting of sequences
H2C/D117: FHENFYDWFVRQVSKK (SEQ ID NO:1556); FHENFYDWFVRQVS (SEQ ID NO:1557); RP9; GSLDESFYDWFERQLGKK (SEQ ID NO:1558); GSLDESFYDWFERQLG (SEQ ID NO:1559); GLADEDFYEWFERQLR (SEQ ID NO:1561); GLADELFYEWFDRQLS (SEQ ID NO:1562); GQLDEDFYEWFDRQLS (SEQ ID NO:1563); GQLDEDFYAWFDRQLS (SEQ ID NO:1564); GFMDESFYEWFERQLR (SEQ ID NO:1565); GFWDESFYAWFERQLR (SEQ ID NO:1566); GFMDESFYAWFERQLR (SEQ ID NO:1567); GFWDESFYEWFERQLR (SEQ ID NO:1568); RP15: SQAGSAFYAWFDQVLRTV (SEQ ID NO:2057); and S175: GRVDWLQRNANFYDWF-VAELG (SEQ ID NO:1560).

24. The amino acid sequence according to claim 14, wherein the Formula 6 sequence is a D8 sequence selected from the group consisting of:
WLDQEWVQCEVYGRGCPSKK (SEQ ID NO:2227); KWLDQEWAWVQCEVYGRGCPSKK (SEQ ID NO:1579); KWLDQEWAWVQCEVYGRGCPS (SEQ ID NO:1580); SLEEEWAQIQCEIYGRGCRY (SEQ ID NO:1581); SLEEEWAQIQCEIWGRGCRY (SEQ ID NO:1582); SLEEEWAQIECEVYGRGCPS (SEQ ID NO:1583); and SLEEEWAQIECEVWGRGCPS (SEQ ID NO:1184).

25. The amino acid sequence according to claim 14, wherein the amino acid sequence is sequence 539 (SEQ ID NO:2116).

26. The amino acid sequence according to claim 14, wherein the amino acid sequences selected from the group consisting of sequences S429 (SEQ ID NO:2032), S455 (SEQ ID NO:2060), S457–S458 (SEQ ID NOS:2063–2064), S467–S468 (SEQ ID NOS:2066–2067), S471 (SEQ ID NO:2068), S471 (SEQ ID NO:2068), S481–S513 (SEQ ID NOS:2069–2101), S517–S520 (SEQ ID NOS:2104–2107), S524(SEQ ID NO:2111), RB539 (SEQ ID NO:2196), RB625–RB626 (SEQ ID NOS:2200 and 2199), and RB622 (SEQ ID NO:2201).

27. The amino acid sequence according to claim 14, wherein the amino acid sequence is selected from the group consisting of sequences RP27 (SEQ ID NO:2213), RP28 (SEQ ID NO:2214), RP29 (SEQ ID NO:2215), RP30 (SEQ ID NO:2216), RP31 (SEQ ID NO:2217), RP32 (SEQ ID NO:2218), RP33 (SEQ ID NO:2219), RP34 (SEQ ID NO:2220), and RP35 (SEQ ID NO:2221).

28. The amino acid sequence according to claim 14, wherein the amino acid sequence is selected from the group consisting of sequences D8-6aa-S 175 (SEQ ID NO:2121), D8-12aa-S175 (SEQ ID NO:2122), D8-6aa-RP 15 (SEQ ID NO:2126), and D86aa-RP17 (SEQ ID NO:2127).

29. A pharmaceutical composition comprising the amino acid sequence according to claim 14, and a physiologically acceptable carrier, excipient or diluent.

30. A method of treating diabetes comprising administering to an individual in need of treatment a therapeutically effective amount of the pharmaceutical composition according to claim 29, thereby treating the diabetes.

* * * * *

UNITED STATES PATENT AND TRADEMARK OFFICE
CERTIFICATE OF CORRECTION

PATENT NO.       : 6,875,741 B2
APPLICATION NO. : 09/962756
DATED            : April 5, 2005
INVENTOR(S)      : Pillutla et al.

It is certified that error appears in the above-identified patent and that said Letters Patent is hereby corrected as shown below:

Column 101, line 51, claim 3: "aspartic aid" should read --aspartic acid--.
Column 101, line 64, claim 6: "17201776 (Table 2)" should read --1720-1776 (Table 2)--.
Column 102, line 15, claim 7: "17201776 (Table 2)" should read --1720-1776 (Table 2)--.
Column 102, line 19, claim 8: "and 18061807)," should read --1806-1807),--.
Column 102, line 20, claim 8: "NO:1%21)," should read --NO:1821),--.
Column 102, line 23, claim 8: "S214-216" should read --S214-S216--.
Column 102, line 24, claim 8: "S219-223" should read --S219-S223--.
Column 102, line 25, claim 8: "S234245" should read --S234-S245--.
Column 102, line 26, claim 8: "S248251" should read --S248-S251--.
Column 102, line 29, claim 8: "(SEQ ID NOS: 19401943)," should read --(SEQ ID NOS: 1940-1943)--.
Column 102, line 30, claim 8: "(SEQ TD" should read --(SEQ ID--.
Column 102, line 42, claim 9: "S284-285" should read --S284-S285--.
Column 102, line 44, claim 9: "(SEQ ID NO:215R)" should read --(SEQ ID NO:2158)--.
Column 103, line 2, claim 11: "SLEEWAQIQCEIYGRGCRY" should read --SLEEEWAQIQCEIYGRGCRY--.
Column 103, line 5, claim 11: "SLEEWAQIECEVWGRGCPS" should read --SLEEEWAQIECEVWGRGCPS--.
Column 103, line 17, claim 14: "$X_1X_2X_3X_4X$" should read --$X_1X_2X_3X_4X_5$--.
Column 103, line 54, claim 18: "WLDQEWAWVQCEVYGROCPS" should read --WLDQEWAWVQCEVYGRGCPS--.

UNITED STATES PATENT AND TRADEMARK OFFICE
CERTIFICATE OF CORRECTION

PATENT NO.       : 6,875,741 B2
APPLICATION NO.  : 09/962756
DATED            : April 5, 2005
INVENTOR(S)      : Pillutla et al.

It is certified that error appears in the above-identified patent and that said Letters Patent is hereby corrected as shown below:

<u>Column 104, line 12, claim 21</u>: "S264S265 (SEQ ID" should read --S264-S265 (SEQ ID--.
<u>Column 104, line 19, claim 21</u>: "S386S403" should read --S386-S403--.
<u>Column 104, line 29, claim 22</u>: "S284285" should read --S284-S285--.

Signed and Sealed this

Twenty-fourth Day of March, 2009

JOHN DOLL
*Acting Director of the United States Patent and Trademark Office*